(12) United States Patent
Werler et al.

(10) Patent No.: US 11,753,684 B2
(45) Date of Patent: Sep. 12, 2023

(54) DETECTION OF FETAL CHROMOSOMAL ANEUPLOIDIES USING DNA REGIONS THAT ARE DIFFERENTIALLY METHYLATED BETWEEN THE FETUS AND THE PREGNANT FEMALE

(71) Applicant: Eurofins LifeCodexx GmbH, Constance (DE)

(72) Inventors: Steffi Werler, Constance (DE); Wera Hofmann, Constance (DE); Matthias Sachse, Constance (DE)

(73) Assignee: EUROFINS LIFECODEXX GMBH, Constance (DE)

( * ) Notice: Subject to any disclaimer, the term of this patent is extended or adjusted under 35 U.S.C. 154(b) by 10 days.

(21) Appl. No.: 15/773,452

(22) PCT Filed: Nov. 9, 2016

(86) PCT No.: PCT/EP2016/077065
§ 371 (c)(1),
(2) Date: May 3, 2018

(87) PCT Pub. No.: WO2017/081047
PCT Pub. Date: May 18, 2017

(65) Prior Publication Data
US 2019/0249249 A1    Aug. 15, 2019

(30) Foreign Application Priority Data

Nov. 10, 2015  (EP) .................................. 15193966

(51) Int. Cl.
| | | |
|---|---|---|
| *C12Q 1/6883* | (2018.01) | |
| *C12Q 1/6851* | (2018.01) | |
| *C12Q 1/6806* | (2018.01) | |
| *C12Q 1/686* | (2018.01) | |

(52) U.S. Cl.
CPC .......... *C12Q 1/6883* (2013.01); *C12Q 1/686* (2013.01); *C12Q 1/6806* (2013.01); *C12Q 1/6851* (2013.01); *C12Q 2600/112* (2013.01); *C12Q 2600/118* (2013.01); *C12Q 2600/154* (2013.01); *C12Q 2600/16* (2013.01)

(58) Field of Classification Search
None
See application file for complete search history.

(56) References Cited

U.S. PATENT DOCUMENTS

| | | |
|---|---|---|
| 5,804,375 A | 9/1998 | Gelfand et al. |
| 5,994,056 A | 11/1999 | Higuchi |
| 6,200,756 B1 | 3/2001 | Herman et al. |
| 6,258,569 B1 | 7/2001 | Livak et al. |
| 6,331,393 B1 | 12/2001 | Laird et al. |
| 6,727,356 B1 | 4/2004 | Reed et al. |
| 6,929,907 B2 | 8/2005 | Agris |
| 9,822,412 B2 | 11/2017 | Gromminger et al. |
| 9,822,413 B2 | 11/2017 | Gromminger et al. |
| 10,017,818 B2 | 7/2018 | Gromminger et al. |
| 2003/0148278 A1 | 8/2003 | Lauter et al. |
| 2003/0165859 A1* | 9/2003 | Nazarenko ....... C12Q 2525/161 435/6.11 |
| 2003/0211522 A1* | 11/2003 | Landes ................ C12Q 1/6876 435/6.12 |
| 2004/0229211 A1 | 11/2004 | Yeung |
| 2005/0239101 A1* | 10/2005 | Sukumar ................ C12Q 1/686 435/6.12 |
| 2006/0019278 A1* | 1/2006 | Lo ........................ C12Q 1/6883 435/6.11 |
| 2007/0059753 A1 | 3/2007 | Vener et al. |

(Continued)

FOREIGN PATENT DOCUMENTS

| | | |
|---|---|---|
| CN | 101985619 A | 3/2011 |
| CN | 102216456 A | 10/2011 |

(Continued)

OTHER PUBLICATIONS

International Search Report and Written Opinion dated Aug. 19, 2015 from International Application No. PCT/EP2015/060188, 16 pages.
Singaporean Search Report and Written Opinion dated Nov. 16, 2017 from Singaporean Application No. 11201608993R, 11 pages.
European Search Report and Written Opinion dated Mar. 18, 2016 from European Application No. 15193966, 9 pages.

(Continued)

*Primary Examiner* — Amanda Haney
(74) *Attorney, Agent, or Firm* — MH2 TECHNOLOGY LAW GROUP, LLP

(57) ABSTRACT

Methods for detecting a chromosomal aneuploidy in a foetus carried by a pregnant female are provided. Such methods are based on one or more of particular configurations and/or detections and/or analyses of two or more regions of DNA, including those that show differential methylation between DNA that originates from cells of a foetus (and/or the placenta of a foetus) and DNA of maternal origin. Such methods utilise a sample taken from a pregnant female, which sample comprises DNA that originates from cells of a foetus and/or the placenta of a foetus in admixture with differently methylated DNA of maternal origin. Such methods have diagnostic, prognostic and/or predictive utility; in particular for the detection/diagnosis of chromosomal aneuploidy, such as a trisomy, in a foetus, and/or for detecting an increased risk of a pregnant female suffering from or developing a pregnancy-associated medical condition. Also disclosed are compositions, kits, computer program products and other aspects that may be used in, useful for or related to the practice of such methods.

28 Claims, 12 Drawing Sheets
Specification includes a Sequence Listing.

(56) References Cited

U.S. PATENT DOCUMENTS

| | | | |
|---|---|---|---|
| 2012/0040859 A1* | 2/2012 | Sparks | C12Q 1/6862 506/9 |
| 2012/0065076 A1 | 3/2012 | Peters et al. | |
| 2012/0252015 A1 | 10/2012 | Tindson et al. | |
| 2012/0282613 A1* | 11/2012 | Patsalis | C12Q 1/6806 435/6.11 |
| 2012/0302448 A1 | 11/2012 | Hutchinson et al. | |
| 2013/0288244 A1* | 10/2013 | Deciu | G16B 20/10 435/6.11 |
| 2013/0337443 A1* | 12/2013 | Lo | C12Q 1/6888 435/6.11 |
| 2019/0085402 A1 | 3/2019 | Kassis | |

FOREIGN PATENT DOCUMENTS

| | | |
|---|---|---|
| CN | 102625854 A | 8/2012 |
| CN | 102648292 A | 8/2012 |
| EP | 0 512 334 B1 | 9/1999 |
| EP | 0 706 649 B1 | 1/2001 |
| EP | 0 792 374 B1 | 1/2001 |
| EP | 1524321 A1 | 4/2005 |
| EP | 0 954 608 B1 | 5/2006 |
| EP | 1 185 695 B1 | 7/2006 |
| EP | 0 543 942 B2 | 11/2006 |
| EP | 1 235 938 B1 | 2/2012 |
| JP | 2005-261354 A | 9/2005 |
| JP | 2007-532100 A | 11/2007 |
| JP | 2013-538565 A | 10/2013 |
| WO | 00/47764 A2 | 8/2000 |
| WO | 03/020974 A2 | 3/2003 |
| WO | 03/062441 A1 | 7/2003 |
| WO | 2005/035725 A2 | 4/2005 |
| WO | 2005/098029 A2 | 10/2005 |
| WO | 2005/118852 A2 | 12/2005 |
| WO | 2007/132166 A2 | 11/2007 |
| WO | 2007/132167 A2 | 11/2007 |
| WO | 2007/140417 A2 | 12/2007 |
| WO | 2010/033639 A2 | 3/2010 |
| WO | 2011/018600 A1 | 2/2011 |
| WO | WO 2011/018600 * | 2/2011 |
| WO | 2011/034631 A1 | 3/2011 |
| WO | 2011/092592 A2 | 8/2011 |
| WO | 2012/007783 A1 | 1/2012 |
| WO | 2012/092592 A1 | 7/2012 |
| WO | 2012/149339 A2 | 11/2012 |
| WO | 2013/057568 A1 | 4/2013 |
| WO | 2013/132305 A1 | 9/2013 |
| WO | 2014/011928 A1 | 1/2014 |
| WO | 2014/043763 A1 | 3/2014 |
| WO | 2014/055790 A2 | 4/2014 |
| WO | 2014/168711 A1 | 10/2014 |
| WO | 2015/013885 A1 | 2/2015 |
| WO | 2015/138774 A1 | 9/2015 |
| WO | 2017/220156 A1 | 12/2017 |

OTHER PUBLICATIONS

Lo et al., "Presence of fetal DNA in maternal plasma and serum", The Lancet, Aug. 16, 1997, vol. 350, pp. 485-487.

Chim et al., "Detection of the placental epigenetic signature of the maspin gene in maternal plasma", Proc. Natl. Acad. Sci. USA, Oct. 11, 2005, vol. 102, No. 41, pp. 14753-14758.

Chiu et al., "Hypermethylation of RASSF1A in Human and Rhesus Placentas", The American Journal of Pathology, Mar. 2007, vol. 170, No. 3, pp. 941-950.

Old et al., "Candidate epigenetic biomarkders for non-invasive prenatal diagnosis of Down syndrome", Reproductive BioMedicine Online, Jun. 21, 2007, vol. 15, No. 2, pp. 227-235.

Chim et al., "Systematic Search for Placental DNA-Methylation Markers on Chromosome 21: Toward a Maternal Plasma-Based Epigenetic Test for Fetal Trisomy 21", Clinical Chemistry, 2008, vol. 54, No. 3, pp. 500-511.

Lo et al., "Prenatal Diagnosis of Fetal RhD Status by Molecular Analysis of Maternal Plasma", The New England Journal of Medicine, Dec. 10, 1998, vol. 339, pp. 1734-1738.

Go et al., "Non-invasive aneuploidy detection using free fetal DNA and RNA in maternal plasma: recent progress and future possibilities", Human Reproduction update, 2011, vol. 17, No. 3, pp. 372-382.

Lo et al., "Quantitative Analysis of Fetal DNA in Maternal Plasma and Serum: Implications for Noninvasive Prenatal Diagnosis", Am. J. Hum. Genet., 1998, vol. 62, pp. 768-775.

Hahn et al., "Cell-Free Nucleic Acids as Potential Markers for Preeclampsia", Placenta, 2011, vol. 32, pp. S17-S20.

Papageorgiou et al., "Fetal-specific DNA methylation ratio permits non-invasive prenatal diagnosis of trisomy 21", Nat. Med., Apr. 7, 2011, vol. 17, No. 4, pp. 510-513.

Tong et al., "Technical concerns about immunoprecipitation of methylated fetal DNA for noninvasive trisomy 21 diagnosis", Nature Medicine, Sep. 2012, vol. 18, No. 9, pp. 1327-1328.

Hindson et al., "High-Throughput Droplet Digital PCR System for Absolute Quantitation of DNA Copy Number", Analytical Chemistry, 2011, vol. 83, pp. 8604-8610.

Lim et al., "Disease specific characteristics of fetal epigenetic markers for non-invasive prenatal testing of trisomy 21", BMC Medical Genomics, 2014, vol. 7, No. 1, pp. 1-11.

Poon et al., "Differential DNA Methylation between Fetus and Mother as a Strategy for Detecting Fetal DNA in Maternal Plasma", Clinical Chemistry, 2002, vol. 48, No. 1, pp. 35-41.

Yegnasubramanian et al., "Combination of methylated-DNA precipitation and methylation-sensitive restriction enzymes (COMPARE-MS) for the rapid, sensitive and quantitative detection of DNA methylation", Nucleic Acids Research, 2006, vol. 34, No. 3, e19, pp. 1-14.

Papantoniou et al., "RASSF1A in maternal plasma as a molecular marker of preeclampsia", Prenatal Diagnosis, 2013, vol. 33, pp. 682-687.

Zeybek et al., "Clinical evaluations of cell-free fetal DNA quantities in pre-eclamptic pregnancies", J. Obstet Gynaecol Res., Mar. 2013, vol. 39, No. 3, pp. 632-640.

Jakobsen et al., "Identifying mild and severe preeclampsia in asymptomatic pregnant women by levels of cell-free fetal DNA", Transfusion, Sep. 2013, vol. 53, pp. 1956-1964.

Chen et al., "Chimerism in Monochorionic Dizygotic Twins: Case Study and Review", Am. J. Med. Genet. Part A, May 22, 2013, vol. 161A, pp. 1817-1824.

Chan et al., "Hypermethylated RASSF1A in Maternal Plasma: A Universal Fetal DNA Marker that Improves the Reliability of Noninvasive Prenatal Diagnosis", Clinical Chemistry, 2006, vol. 52, No. 12, pp. 2211-2218.

Stumm et al., "Diagnostice accuracy of random massively parallel sequencing for non-invasive prenatal detection of common autosomal aneuploidies: a collaborative study in Europe", Prenatal Diagnosis, 2014, vol. 34, pp. 185-191.

Eung et al., "Noninvasive twin zygosity assessment and aneuploidy detection by maternal plasma DNA sequencing", Prenatal Diagnosis, 2013, vol. 33, pp. 675-681.

Qu et al., "Noninvasive Prenatal Determination of Twin Zygosity by Maternal Plasma DNA Analysis", Clinical Chemistry, 2013, vol. 59, vol. 2, pp. 427-435.

Struble et al., "Fetal Fraction Estimate in Twin Pregnancies Using Directed Cell-Free DNA Analysis", Fetal Diagnosis and Therapy, Dec. 7, 2013, pp. 1-5.

Sperling et al., "Twin pregnancy: the role of ultrasound in management", Acta Obstet Gynecol Scand, 2001, vol. 80, pp. 287-299.

Norwitz et al., "Noninvasive Prenatal Testing: The Future is Now", Reviews in Obstetrics & Gynecology, 2013, vol. 6, No. 2, pp. 48-62.

Papageorgiou et al., "Sites of Differential DNA Methylation between Placenta and Peripheral Blood", The American Journal of Pathology, May 2009, vol. 174, No. 5, pp. 1609-1618.

Lim et al., "Non-Invasive Epigenetic Detection of Fetal Trisomy 21 in First Trimester Maternal Plasma", PLoS One, Nov. 2011, vol. 6, No. 11, e27709, 8 pages.

(56) References Cited

OTHER PUBLICATIONS

Tong et al., "Noninvasive Prenatal Detection of Trisomy 21 by an Epigenetic-Genetic Chromosome-Dosage Approach", Clinical Chemistry, 2010, vol. 56, No. 1, pp. 90-98.
Tsaliki et al., "MeDIP real-time qPCR of maternal peripheral blood reliably identifies trisomy 21", Prenatal Diagnosis, 2012, vol. 32, pp. 996-1001.
Lim et al., "Non-invasive detection of fetal trisomy 21 using fetal epigenetic biomarkers with a high CpG density", Clin Chem Lab Med, 2014, vol. 52, No. 5, pp. 641-647.
Chim et al., "Potential application of fetal epigenetic markers on the non-invasive prenatal detection of chromosomal abnormality", Clin Chem Lab Med, 2014, vol. 52, No. 5, pp. 585-588.
Nygren et al., "Quantification of Fetal DNA by Use of Methylation-Based DNA Discrimination", Clinical Chemistry, 2010, vol. 56, No. 10, pp. 1627-1635.
Yin et al., "Placental methylation markers in normal and trisomy 21 tissues", Prenatal Diagnosis, 2014, vol. 34, pp. 63-70.
Tong et al., "Detection of Restriciton Enzyme-Digested Target DNA by PCR Amplification Using a Stem-Loop Primer: Application to the Detection of Hypomethylated Fetal DNA in Maternal Plasma", Clinical Chemistry, 2007, vol. 53, No. 11, pp. 1906-1914.
Ragione et al., "Differential DNA Methylation as a Tool for Non-invasive Prenatal Diagnosis (NIPD) of X Chromosome Aneuploidies", Journal of Molecular Diagnostics, Nov. 2010, vol. 12, No. 6, pp. 797-807.
Tong et al., "Diagnostic developments involving cell-free (circulating) nucleic acids", Clinical Chimica Acta, 2006, vol. 363, pp. 187-196.
Hatt et al., "Microarray-Based Analysis of Methylation Status of CpGs in Placental DNA and Maternal Blood DNA—Potential New Epigenetic for Cell Free Fetal DNA-Based Diagnosis", PLoS One, Jul. 31, 2015, vol. 10, No. 7, e0128918, 12 Pages.
International Search Report and Written Opinion dated Feb. 3, 2017 from International Application No. PCT/EP2016/077065, 14 pages.
Snellenberg et al., "Development of a multiplex methylation-specific PCR as candidate triage test for women with an HPV-positive cervical scrape", BMC Cancer, 2012, vol. 12, 9 pages.
Olkhov-Mitsel et al., "Novel Multiplex MethyLight Protocol for Detection of DNA Methylation in Patient Tissues and Bodily Fluids", Scientific Reports, Mar. 21, 2014, vol. 4, 8 pages.
Swift-Scanlan et al., "Two-color quantitative multiplex methylation-specific PCR", BioTechniques, Feb. 2006, vol. 40, No. 2, pp. 210-219.
Lee et al., "Non-Invasive Prenatal Testing of Trisomy 18 by an Epigenetic Marker in First Trimester Maternal Plasma", PLOS One, Nov. 2013, vol. 8, No. 11, 8 pages.
Tong et al., "Noninvasive Prenatal Detection of Fetal Trisomy 18 by Epigenetic Allelic Ratio Analysis in Maternal Plasma: Theoretical and Empirical Considerations", Clinical Chemistry, 2006, vol. 52, No. 12, pp. 2194-2202.
Sorenson et al., "Soluble Normal and Mutated DNA Sequences from Single-Copy Genes in Human Blood", Cancer Epidemiology, Biomarkers & Prevention, Jan./Feb. 1994, vol. 3, pp. 67-71.
Vasioukhin et al., "Point mutations of the N-ras gene in the blood plasma DNA of patients with myelodysplastic syndrome or acute myelogenous leukaemia", British Journal of Haematology, 1994, vol. 86, pp. 774-779.
Muller et al., "Methylated DNA as a possible screening marker for neoplastic disease in several body fluids", Expert Rev. Mol. Diagn., 2003, vol. 3, No. 4, pp. 443-458.
Lo et al., "Quantitative Analysis of the Bidirectional Fetomaternal Transfer of Nucleated Cells and Plasma DNA", Clinical Chemistry, 2000, vol. 46, No. 9, pp. 1301-1309.
Smid et al., "Correlation of fetal DNA levels in maternal plasma with Doppler status in pathological pregnancies", Prenat Diag, 2006, pp. 785-790.
Lo et al., "Rapid Clearance of Fetal DNA from Maternal Plasma", Am. J. Hum. Genet, 1999, vol. 64, pp. 218-224.

Kawai et al., "Methylation profiles of genomic DNA of mouse developmental brain detected by restriction landmark genomic scanning (RLGS) method", Nucleic Acids Research, 1993, vol. 21, No. 24, pp. 5604-5608.
Masuzaki et al., "Detection of cell free placental DNA in maternal plasma: direct evidence from three cases of confined placental mosaicism", J. Med. Genet, 2004, vol. 41, pp. 289-292.
Flori et al., "Circulating cell-free fetal DNA in maternal serum appears to originate from cyto- and syncytio-trophoblastic cells. Case Report", Human Reproduction, Jan. 29, 2004, vol. 19, No. 3, pp. 723-724.
Lo et al., "Quantitative Abnormalities of Fetal DNA in Maternal Serum in Preeclampsia", Clinical Chemistry, 1999, vol. 45, No. 2, pp. 184-188.
Yu et al., "Quantification of Maternal Serum Cell-Free Fetal DNA in Early-Onset Preeclampsia", Int. J. Mol. Sci, Apr. 8, 2013, vol. 4, pp. 7571-7582.
Li et al., "Hypermethylation of multiple tumor-related genes associated with DMNT3b upregulation served as a biomarker for early diagnosis of esophageal squamous cell carcinoma", Epigenetics, Mar. 2011, vol. 6, No. 3, pp. 307-316.
Ha et al., "Elevated Levels of Cell-Free Circulating DNA in Patients with Acute Dengue Virus Infection", PLoS One, Oct. 7, 2011, vol. 6, No. 10, e25969, pp. 1-7.
Outinen et al., "Plasma Cell-Free DNA Levels Are Elevated in Acute Puumula Hantavirus Infection", PLoS One, Feb. 7, 2012, vol. 7, No. 2, e31455, pp. 1-7.
Forsblom et al., "High Cell-Free DNA Predicts Fatal Outcome among *Staphylococcus aureus* Bacteraemia Patients with Intensive Care Unit Treatment", PloS One, Feb. 10, 2014, vol. 9, No. 2, e87741, pp. 1-9.
Chan et al., "Size Distributions of Maternal and Fetal DNA in Maternal Plasma", Clinical Chemistry, 2004, vol. 50, No. 1, pp. 88-92.
Kimura et al., "Fragment Size Analysis of Free Fetal DNA in Maternal Plasma Using Y-STR Loci and SRY Gene Amplification", Nagoya J. Med. Sci., 2011, vol. 73, pp. 129-135.
Lo et al., "Maternal Plasma DNA Sequencing Reveals the Genome-Wide Genetic and Mutational Profile of the Fetus", Science Translational Medicine, Dec. 8, 2010, vol. 2, No. 61, 61ra91 pp. 1-14.
Elshimali et al., "The Clinical Utilization of Circulating Cell Free DNA (CCFDNA) in Blood of Cancer Patients", International Journal of Molecular Sciences, 2013, vol. 14, pp. 18925-18958.
Bacha Zeerleder, "The struggle to detect circulating DNA", Critical Care, 2006, vol. 10, No. 142, pp. 1-3.
Kirsch et al., "An Improved Method for the Isolation of Free-Circulating Plasma DNA and Cell-Free DNA from Other Body Fluids", Ann. N.Y. Acad. Sci., 2008, vol. 1137, pp. 135-139.
Gauthier et al., "Blood Clearance Kinetics and Liver Uptake of Mononucleosomes in Mice", The Journal of Immunology, 1996, vol. 156, pp. 1151-1156.
Lo et al., "Quantitative Analysis of Aberrant p16 Methylation Using Real-Time Quantitative Methylation-specific Polymerase Chain Reaction", Cancer Research, Aug. 15, 1999, vol. 59, pp. 3899-3903.
Birch et al., "Accurate and Robust Quantification of Circulating Fetal and Total DNA in Maternal Plasma from 5-41 Weeks of Gestation", Clinical Chemistry, 2005, vol. 51, No. 2, pp. 312-320.
White et al., "Evaluation of a Novel Assay for Detection of the Fetal Marker RASSF1A: Facilitating Improved Diagnostic Reliability of Noninvasive Prenatal Diagnosis", PLoS One, Sep. 14, 2012, vol. 7, No. 9, e45073 pp. 1-5.
Campan et al., "MethyLight", DNA Methylation: Methods and Protocols, 2nd Edition, vol. 507, 2009, pp. 325-337.
De et al., "Development of a multplex MethyLight assay for the detection of multigene methylation in human colorectal cancer", Cancer Genetics and Cytogenetics, vol. 202, No. 1, 2010, pp. 1-10.
Weisenberger et al., "Analysis of repetitive element DNA methylation by MethyLight", Nucleic Acids Research, vol. 33, No. 21, 2005, pp. 6823-6836.
Weisenberger et al., "DNA methylation analysis by digital bisulfite genomic sequencing and digital MethyLight", Nucleic Acids Research, vol. 36, No. 14, 2008, pp. 4689-4698.

(56) References Cited

OTHER PUBLICATIONS

Indian Office Action dated Jun. 30, 2020 for Indian Patent Application No. 201617040933 (Controller, Dr. Jyoti), 8 pages.
Japanese Office Action dated Mar. 19, 2019 for Japanese Patent Application No. 2016-566621, 13 pages with English translation.
Russian Office Action dated Dec. 27, 2018 for Russian Patent Application No. 2016147914, 13 pages with English translation.
Papageorgiou et al., "Non-invasive prenatal diagnosis of aneuploidies: new technologies and clinical applications", Genome Medicine, 2012, vol. 4, No. 5, 12 pages.
Clausen et al., "Evaluation of Two Real-Time Multiplex PCR Screening Assays Detecting Fetal RHD in Plasma from RhD Negative Women to Ascertain the Requirement for Antenatal RhD Prophylaxis", 2011, Fetal Diagn Ther, vol. 29, pp. 155-163.
Deng et al., "Noninvasive genotyping of 9 Y-chromosome specific STR loci using circulatory fetal DNA in maternal plasma by multiplex PCR", 2006, Prenat Diagn, vol. 26, pp. 362-368.
Hahn et al., "Multiplex and Real-Time Quantitative PCR on Fetal DNA in Maternal Plasma", 2000, Annals of the New York Academy of Sciences, vol. 906, pp. 148-152.
Johnson et al., "Interlaboratory Comparison of Fetal Male DNA Detection from Common Maternal Plasma Samples by Real-Time PCR", 2004, Clinical Chemistry, vol. 50, No. 3, pp. 516-521.
Kolialexi et al., "Early non-invasive detection of fetal Y chromosome sequences in maternal plasma using multiplex PCR", 2012, European Journal of Obstetrics & Gynecology and Reproductive Biology, vol. 161, pp. 34-37.
Macher et al., "Standardization non-invasive fetal RHD and SRY determination into clinical routine using a new multiplex RT-PCR assay for fetal cell-free DNA in pregnant women plasma: Results in clinical benefits and cost saving", 2012, Clinica Chimica Acta, vol. 413, pp. 490-494.
Ordonez et al., "Development and Validation of Multiplex Real-Time PCR Assay for Noninvasive Prenatal Assessment of Fetal RhO Status and Fetal Sex in Maternal Plasma", 2013, Fetal Diagn Ther, vol. 34, pp. 13-18.
Tounta et al., "A Multiplex PCR for Non-invasive Fetal RHD Genotyping Using Cell-free Fetal DNA", 2011, In vivo, vol. 25, pp. 411-418.
Xia et al., "Simultaneous quantitative assessment of circulating cell-free mitochondrial and nuclear DNA by multiplex real-time PCR", 2009, Genetics and Molecular Biology, vol. 32, No. 1, pp. 20-24.
Zhong et al., "Risk free simultaneous prenatal identification of fetal Rhesus D status and sex by multiplex real-time PCR using cell free fetal DNA in maternal plasma", 2001, Swiss Med Wkly, vol. 131, pp. 70-74.
Zimmermann et al., "Use of Real-Time Polymerase Chain Reaction for the Detection of Fetal Aneuploidies", 2006, Methods in Molecular Biology, vol. 336, pp. 83-100.

* cited by examiner

DETECTION OF FETAL CHROMOSOMAL ANEUPLOIDIES USING DNA REGIONS THAT ARE DIFFERENTIALLY METHYLATED BETWEEN THE FETUS AND THE PREGNANT FEMALE

CROSS-REFERENCE TO RELATED APPLICATIONS

This application is a U.S. National Stage application of PCT/EP2016/077065 filed 9 Nov. 2016, which claims priority to European Application No. 15193966.7 filed 10 Nov. 2015, the entire disclosures of which are hereby incorporated by reference in their entirety.

SEQUENCE LISTING

The instant application contains a Sequence Listing which has been submitted electronically in ASCII format and is hereby incorporated by reference in its entirety. Said ASCII copy, created on 29 Aug. 2018, is named DFMP-117-US-SL.TXT and is 1,614 kilobytes in size.

DESCRIPTION

The present invention relates to methods for detecting a chromosomal aneuploidy in a foetus carried by a pregnant female. Such methods are based on one or more of particular configurations and/or detections and/or analyses of two or more regions of DNA, including those that show differential methylation between DNA that originates from cells of a foetus (and/or the placenta of a foetus) and DNA of maternal origin. Such methods utilise a sample taken from said pregnant female, which sample comprises DNA that originates from cells of a foetus and/or the placenta of a foetus in admixture with differently methylated DNA of maternal origin. Such methods have diagnostic, prognostic and/or predictive utility; in particular for the detection/diagnosis of chromosomal aneuploidy, such as a trisomy, in a foetus, and/or for detecting an increased risk of a pregnant female suffering from or developing a pregnancy-associated medical condition. The present invention also relates to compositions, kits, computer program products and other aspects that may be used in, useful for or related to the practice of such methods.

In most developed countries, many pregnant women undergo prenatal testing for which the main objective is the identification of chromosomal aneuploidy in the developing foetus. Until recently, almost all reliable such prenatal tests were invasive, such as chorionic villus sampling (CVS) or amniocentesis, and carried a not insignificant risk of procedure-related miscarriage despite the diagnostic accuracy of such testing having been reported as between 97.% to 99.8% (for review, see Norwitz & Levy 2013, Rev Obs Gyn 6:48). Conventional non-invasive prenatal testing for foetal chromosomal aneuploidy includes screening by ultra-sound and/or analysis of various maternal serum biochemical markers. However, these tests are primarily targeted to the detection of Down syndrome (trisomy chromosome 21 (T21) and, to a lesser extent, T18). However, with reported detection rates of only 75% to 96% (depending on the screening approach utilised) and with false-positive rates ranging from 5% to 10%, such ultrasound and maternal serum analyses are commonly considered only as screening procedures, with both requiring follow-up by CVS or amniocentesis in screen-positive cases for a definitive diagnosis of a chromosome abnormality in the foetus (Norwitz & Levy 2013).

The discovery of cell-free DNA (cfDNA) in maternal circulation that originates from the foetus (Lo et al 1997, Lancet 350:485) has provided an alternative approach for the development of assays for non-invasive prenatal testing (NIPT), including assays for foetal sex determination (Lo et al 1997) as well as foetal Rhesus D testing in pregnancies where the mother is Rhesus D negative (Lo 1998, N Eng J Med 229: 1734). However, given such foetal cfDNA existing as a minor fraction of total cfDNA isolated from material plasma (Lo et al 1998, Am J Hum Genet 63:768), the detection of foetal chromosome aneuploidies using on the basis of foetal cfDNA from maternal plasma remains challenging. The application of high-throughout next-generation sequencing (NGS) technologies has enabled the sequencing of both foetal and maternal contributions to cfDNA in maternal plasma, and only in recent years has it been possible to offer NGS-based NIPT for chromosome 21 and certain other common foetal aneuploidies routinely to pregnant women, for example with the advent and general availability of commercial tests. Commercially available tests can use random NGS such as "MATERNIT21" (World Wide Web at sequenon.com), "PRENATEST" (World Wide Web at lifecodexx.com), "VERIFI" (World Wide Web at illumina.com) or IONA (World Wide Web at premaitha.com), or may use targeted approaches, the aim of which is to enrich specific genomic regions of interest before sequencing to reduce the number of sequence tags needed to perform a reliable statistical analysis (eg "HARMONY" World Wide Web at ariosadx.com or "PANORAMA" World Wide Web at natera.com), polymorphism analysis or digital PCR (for review, see Go et al 2011, Human Reprod Update 17:372).

To date, such commercially available NIPTs that follow a sequencing approach require the use of complicated and very expensive equipment such as massively parallel sequencers, and have a turn around of several to up to ten days; largely driven by the need for substantial sample processing prior to analysis. For example, NIPT for foetal aneuploidy by NGS requires the time- and cost-consuming step of consisting a so-call "sequencing library" of multi-millions of individual fragments of isolated cfDNA. Alternative NIPTs that follow digital PCR require the use of such equipment and technology that is not typically available except in very specialised and localised research laboratories, and at relatively low throughout (Hindson et al 2011, Anal Chem 83:8604).

Recognising this significant limitation on NIPT from cfDNA, a number of researches have sought to investigate and develop alternative, and in particular cheaper and faster, ways of conducting NIPT for foetal aneuploidy. Many of these alternatives for NIPT have focused on the use of foetal-specific characteristics of the foetal DNA found in maternal plasma (such as specific species of or polymorphisms in foetal cfDNA). In particular, the presence of regions of DNA that are specifically methylated in the foetal DNA compared to maternal DNA has led to substantial efforts into the use of such epigenetic markers for NIPT of foetal chromosomes of interest.

The first demonstration of the use of an epigenetic marker to specifically identify foetal DNA in maternal plasma was made as long ago as 2002 (Poon et al 2002, Clin CHem 48:35; WO 2003/020974), although the utility of the marker used was limited to certain foetal-maternal pairs as it was polymorphic-dependent. A more generally applicable foetal-specific epigenetic marker was the methylated form of the serpin peptidase inhibitor clade B member 5 (also known as maspin) gene ("U-maspin" or "U-SERPINB5") was identified in 2005 following a candidate gene approach (Chim et al 2005, PNAS 102:14753). The maspin gene is located on human chromosome 18, and the principle demonstrated for the first time that non-invasive identification of foetal trisomy 18 could be conducted using such an epigenetic marker (Tong et al 2006, Clin Chem 52:2194; WO 2005/118852).

With such an in-principle demonstration, a number of groups set out to identify further foetal epigenetic markers, in particular those on chromosomes associated with foetal aneuploidy such as chromosome 21 (for example, Old et al 2007, Reprod Biomed Online; Chim at al 2008, Clin Chem 54:500; Papageorgiou et al 2009. Am J Pathol 174:1609; WO 2007/132166; WO 2007/132167; WO 2011/034631; and WO 2011/092592), with the goal of exploiting such epigenetic markers for NIPT of foetal aneuploidy by quantifying eg a chromosome 21-derived sequence in epigenetically identified foetal cfDNA, relative to a reference sequence derived from another autosome or sex chromosome (eg Old et al 2007).

Certain of these epigenetic markers have been investigated as tools to NIPT. Indeed, the unmethylated form of the phosphodiesterase 9A gene (U-PDE9A) has been used in an NIPT test for foetal trisomy 21 (Lim et al 2011, PLoS One 6:e27709). In another study, the methylated form of the holocarboxylase synthetase gene (M-HLCS) has been used as a foetal epigenetic marker to compare relative chromosome 21 dosage normalised against the concentrations of a foetal genetic marker, zinc finger protein Y-Linked (ZFY) gene, on chromosome Y. This epigenetic-genetic ("EGG") approach was demonstrated to be useful for the non-invasive detection of foetal trisomy 21 (Tong et al 2010, Clin Chem 56:90). Using a different approach, Papageorgiou and colleagues described the use of an immunoprecipitation and real-time quantitative polymerase chain reaction (qPCR) approach to quantify the relative amount of a foetal-specific differentially methylated regions (DMRs) chromosome 21 compared to maternal DNA from whole blood, to argue that the slight excess in chromosome 21 amount in trisomy cases could be detected and diagnostic of foetal trisomy 21 (Papageorgiou et al 2011, Nat Med 17:510), and they hypothesised that a combination of DMRs and not a single DMR may be able to give an accurate NIPD of normal and trisomy 21 cases. In a later study, it was reported that in a larger blinded validation study such an approach demonstrated 100% sensitivity and 99.2 specificity (Tsaliki et al 2012, Prenat Diag 21:996). Not only does such an approach require a cumbersome and technically challenging methylated DNA immunoprecipitation (MeDiP) step, but significant technical concerns about using such an approach have been raised (Tong et al 2012, Nat Med 18:1327). In particular, that by using such an approach it is not possible to conclude that the observation of an elevated level of foetal-derived DNA methylation of chromosome 21 markers in maternal blood is due to the presence of a foetus with trisomy 21, as compared to a euploid foetus that happens to release a high amount of cell-free foetal DNA or a high number of foetal cells into the maternal blood. In their commentary of the MeDiP approach, Tong and colleagues suggest that a normalisation step could be included to control for variations in foetal-DNA concentrations using foetal epigenetic markers outside of chromosome 21, but that the previously published study using RASSF1, a gene on chromosome 3, has indicated that compared to the EGG approach, the effect of such normalisation is typically suboptimal, even for placental tissues, which contain primarily foetal DNA (Tong et al 2010).

However, in a recent study, starting with a step to enrich for methylated DNA from maternal primer, Lim and colleagues use conventional qPCR to measure the relative dosage of chromosome 21 (using M-HLCS) compared to the reference chromosome 3 (M-RASSF1A) to report a sensitivity of 90% and a specificity of 92.5% in the non-invasive prenatal detection of foetal trisomy 21 (Lim et al 2014, Clin Chem Lab Med 52:641). Despite this seeming improvement on the initial work reported by Tong and colleagues (Tong et al 2010), It has been reported that there is room for improvement for Lim's approach (Chim 2014, Clin Chem Lab Med 52:585). Indeed, to explore ways to improve the performance of using foetal epigenetic markers for NIPT for foetal trisomy 21, Chim tabulated the salient features of other studies similar to Lim (see TABLE A, adapted from Chim 2014)

TABLE A

Studies on non-invasive prenatal detection of trisomy 21 using foetal epigenetic markers (adapted from Chim 2014)

| Study | Pre-treatment* | Quant. Method | Foetal Chr21 marker | Foetal Ref marker (Chr) | Nature of ref marker | Sensitivity | Specificity |
|---|---|---|---|---|---|---|---|
| Tong et al 2010 | MSRE | Digital PCR | M-HLCS | ZFY | Genetic | 100.0% | 95.8% |
| Lim et al 2011 | MBD | qPCR | U-PDE9A | M-PDE9A + U-PDE9A | Epigenetic | 83.3% | 94.4% |
| Lim et al 2014 | MBD | qPCR | M-HLCS | M-RASSF1A | Epigenetic | 90.0% | 92.5% |

*MSRE: methylation-sensitive restriction enzyme digestion;
MBD: methyl-CpG binding domain-based enrichment;

Chim summarise that: (a) digital PCR seems to give better sensitivity and specificity, compared with the conventional quantitative and suggest that translating the exponential but analogue nature of qPCR into a, '1' or '0' signal in digital PCR, digital counting platforms should facilitate more precise and accurate quantification; and (2) the use of foetal genetic markers seems to give better sensitivity and specificity, rather than foetal epigenetic markers, to quantify a reference chromosome for relative chromosome dosage analysis. Indeed, similarly presenting the results obtained by Tong and colleagues (2010) in their comparative study of the EGG approach compared to the analogous epigenetic-epigenetic approach, Chim describe that normalising against a foetal epigenetic marker, namely M-RASSF1A located on chromosome 3, Tong and colleagues found that the relative dosage of chromosome 21 of more than half of the trisomy 21 placentas studies overlapped with the euploid (normal) reference interval leading to an unworkable sensitivity of 25% (see TABLE B).

TABLE B

Data from Tong et al (2010) on the prenatal detection of trisomy 21 using foetal epigenetic or genetic markers as reference (adapted from Chim 2014)

| Samle | Pre-treat-ment* | Quant. Method | Foetal Chr21 marker | Foetal Ref marker (Chr) | Nature of ref marker | Sensi-tivity | Speci-ficity |
|---|---|---|---|---|---|---|---|
| Placenta | MSRE | Digital PCR | M-HLCS | M-RASSF1A | Epigenetic | 25.0% | 100.0% |
| Placenta | MSRE | Digital PCR | M-HLCS | ZFY | Genetic | 100.0% | 100.0% |
| Maternal plasma | MSRE | Digital PCR | M-HLCS | ZFY | Genetic | 100.0% | 95.8% |

Therefore, despite there being a long-felt need for improved NIPT for foetal aneuploidies and, since 2002, the theoretical possibility to use foetal-specific epigenetic markers to do so, there has to date been no satisfactory, reliable, sensitive, specific, cost effective and/or technically straightforward approach to do so. Indeed, even in his recent review, Chim argues there is still a need for improvement, and concludes that only the use of digital PCR platform and normalisation with a foetal genetic marker will further improve the performance of such epigenetic-based tests. However, digital PCR approaches require the use of technically challenging apparatus which are not typically available except in very specialised and localised research laboratories, and the use of a foetal genetic marker (ie, one that is genetically different to the maternal genome) limits the applicability of such tests only to certain foetal-maternal pairs where such a genetic difference exists (such as male foeti and use of ZFY as the genetic marker) and requires the additional sex or genetic testing for such a genetic difference before the NIPT for foetal aneuploidy can be interpreted.

Accordingly there is a need, from one or more of the above or perspectives, for improved methods, and related other aspects, to detect, indicate or diagnose the presence of a chromosomal aneuploidy in a foetus in particular such methods that are non-invasive and/or use more conventional processing, technical and/or detection steps/equipment, and hence may be conducted faster, more cost effectively and/or more widely in the community.

Accordingly, it is an object of the present invention to provide alternative, improved, simpler, cheaper and/or integrated means or methods that address one or more of these or other problems. Such an object underlying the present invention is solved by the subject matter as disclosed or defined anywhere herein, for example by the subject matter of the attached claims.

Generally, and by way of brief description, the main aspects of the present invention can be described as follows:

In a first aspect, and as may be further described, defined, claimed or otherwise disclosed herein, the invention relates to a method for detecting a chromosomal aneuploidy in a foetus carried by a pregnant female, said method comprising the steps:

(a) providing a sample taken from said pregnant female, which sample comprises DNA that originates from cells of a foetus and/or the placenta of a foetus in admixture with differently methylated DNA of maternal origin;

(b) treating the DNA present in said sample with a reagent that differentially modifies methylated and non-methylated DNA;

(c) determining an amount of a first target species of DNA, being the chromosome relevant to the chromosomal aneuploidy, in said sample by detecting in said sample the presence of methylation at two or more first target differentially methylated regions (DMRs) located on said chromosome, said first target DMRs differently methylated between DNA that originates from cells of a foetus and/or the placenta of a foetus and DNA of maternal origin, the modification of DNA of the first target DMRs by said reagent is sensitive to methylation of DNA, wherein a detected amount of methylated DNA at one or more of said first target DMRs indicates said amount of first target species of DNA in said sample;

(d) determining an amount of reference species of DNA, being one or more reference chromosomes, in said sample by detecting in said sample the presence of methylation at two or more reference DMRs located on said reference chromosome(s), said reference DMRs differently methylated between DNA that originates from cells of a foetus and/or the placenta of a foetus and DNA of maternal origin, the modification of DNA of such reference DMRs by said reagent is sensitive to methylation of DNA, wherein a detected amount of methylated DNA at one or more of said reference DMRs indicates said amount of reference species of DNA in said sample; and (e) determining relative amount(s), preferable ratio(s), of an amount determined from step (c) and an amount determined from step (d), wherein one or more of said relative amount(s) indicates the presence or absence of the chromosomal aneuploidy in the foetus, preferably wherein, said detections in step (c) and step (d) are made using the same aliquot of DNA of said sample, and in the same vessel, and effectively simultaneously for said first target DMRs and said reference DMRs, and optionally, using: (x) the same detectable labels(s) for at least two of said reference DMRs; and/or (y) a different detectable label(s) for at least two of said first target DMRs.

In a second aspect, and as may be further described, defined, claimed or otherwise disclosed herein, the invention relates to a method for detecting an increased risk of a pregnant female suffering from or developing a pregnancy-associated medical condition; said method comprising the steps:

(i) conducting a method of the first aspect, where such method further comprises the step:

(f) determining an amount of total DNA in said sample by detecting at least one other region (OR) that is not differentially methylated between DNA that originates from cells of a foetus and/or the placenta of a foetus and DNA of maternal origin, the modification of which OR(s) by said reagent is insensitive to methylation of DNA, preferably wherein, said detections in step (c) and step (d) and step (f) are made using the same aliquot of DNA of said sample, and in the same vessel, and effectively simultaneously for said first target DMRs and said reference DMRs and said other region(s), and, optionally, using: (x) the same detectable labels(s) for at least two of said reference DMRs; and/or (y) a different detectable label(s) for at least two of said first target DMRs and for at least one of said OR(s).

(ii) determining at least one amount, such as an absolute or relative amount, of foetal DNA present in the sample; and (iii) comparing the amount of foetal DNA determined with a threshold and/or reference distribution, wherein an increase in, or outlying of, the amount of said foetal of DNA from said threshold and/or reference distribution indicates an increased risk of the pregnant female suffering from or developing said pregnancy-associated medical condition.

In other aspects, the invention also relates to a composition, a kit (or components thereof) and a computer program product, in each case as may be described, defined, claimed or otherwise disclosed herein, where such other aspects may be related to, useful for or for use within or in connection with a method of the invention.

The figures show:

Figure 4:
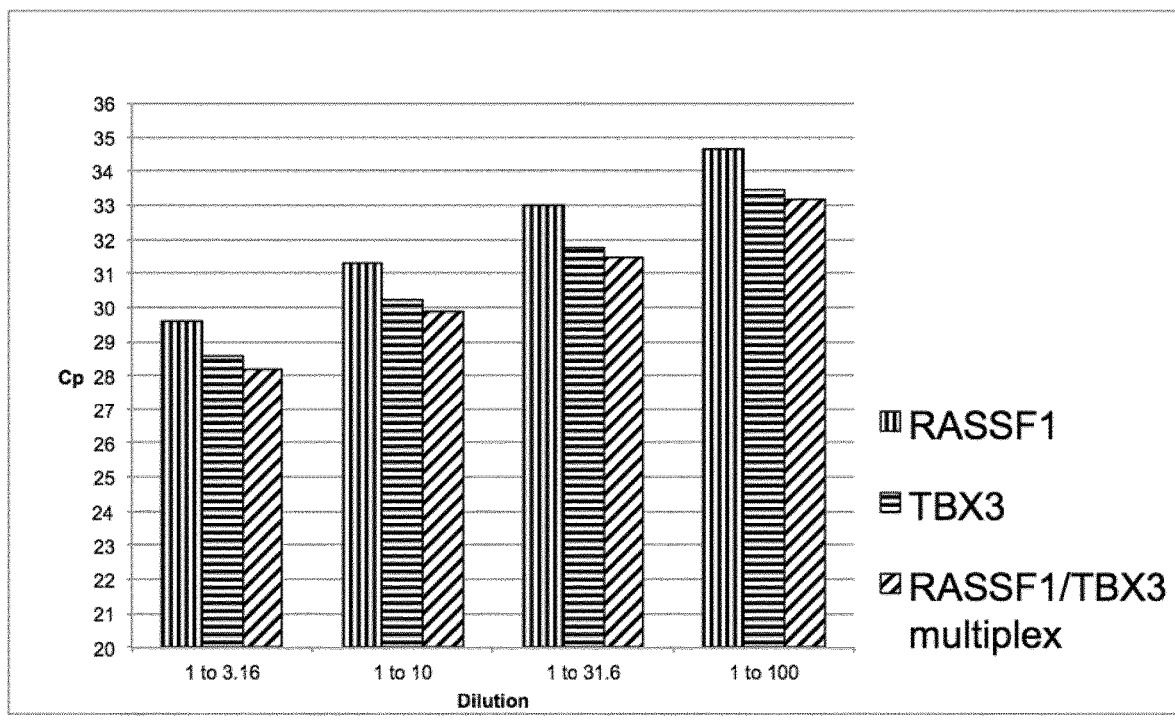

FIG. 4 depicts the improved sensitivity of the detection of reference chromosomes using a multiplex differential methylation-based DNA detection method compared to detection of reference chromosomes detected using separate reactions of a single DMR. The number of PCR cycles (Cp) required for detection of foetal cfDNA derived from reference chromosomes (Example 2) in a sample using either RASSF1A or TBX3 alone as a single DMR, or as a multiplex (using the same labels) of RASSF1A and TBX3.

Figure 5:
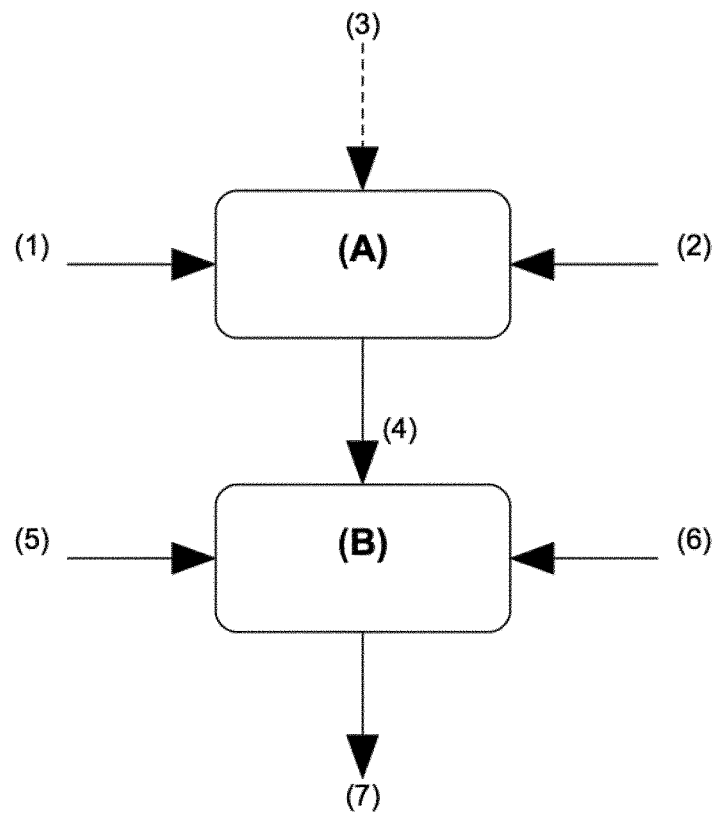

FIG. 5 depicts a schematic representation of the operations conducted by a computer program product of EXAMPLE 3.

Figure 6:
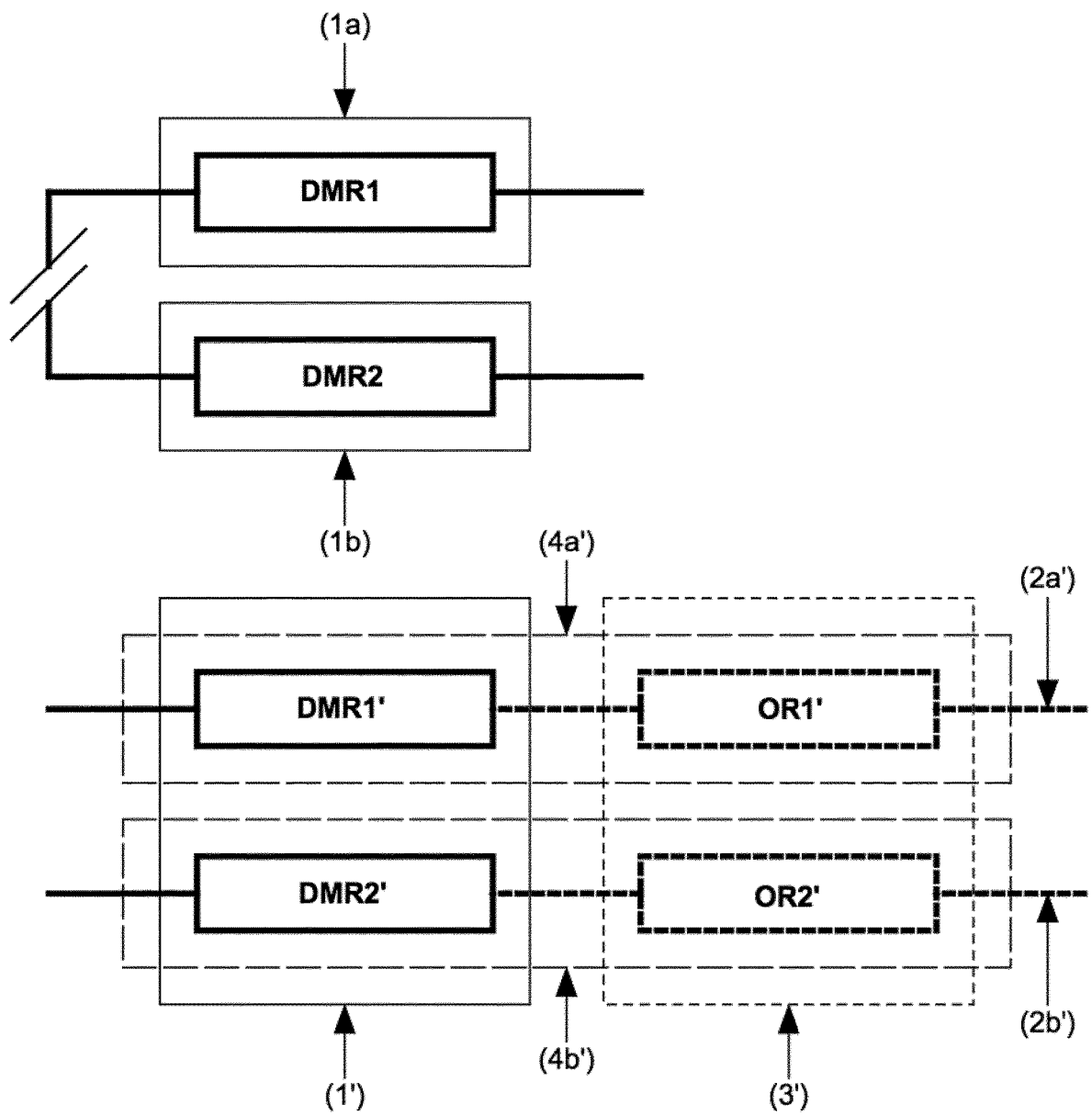

FIG. 6 depicts a schematic representation of the differentially methylated regions ("DMR") (and optional other regions ("OR")) used in EXAMPLE 4 as a method of the present invention.

Figure 7:
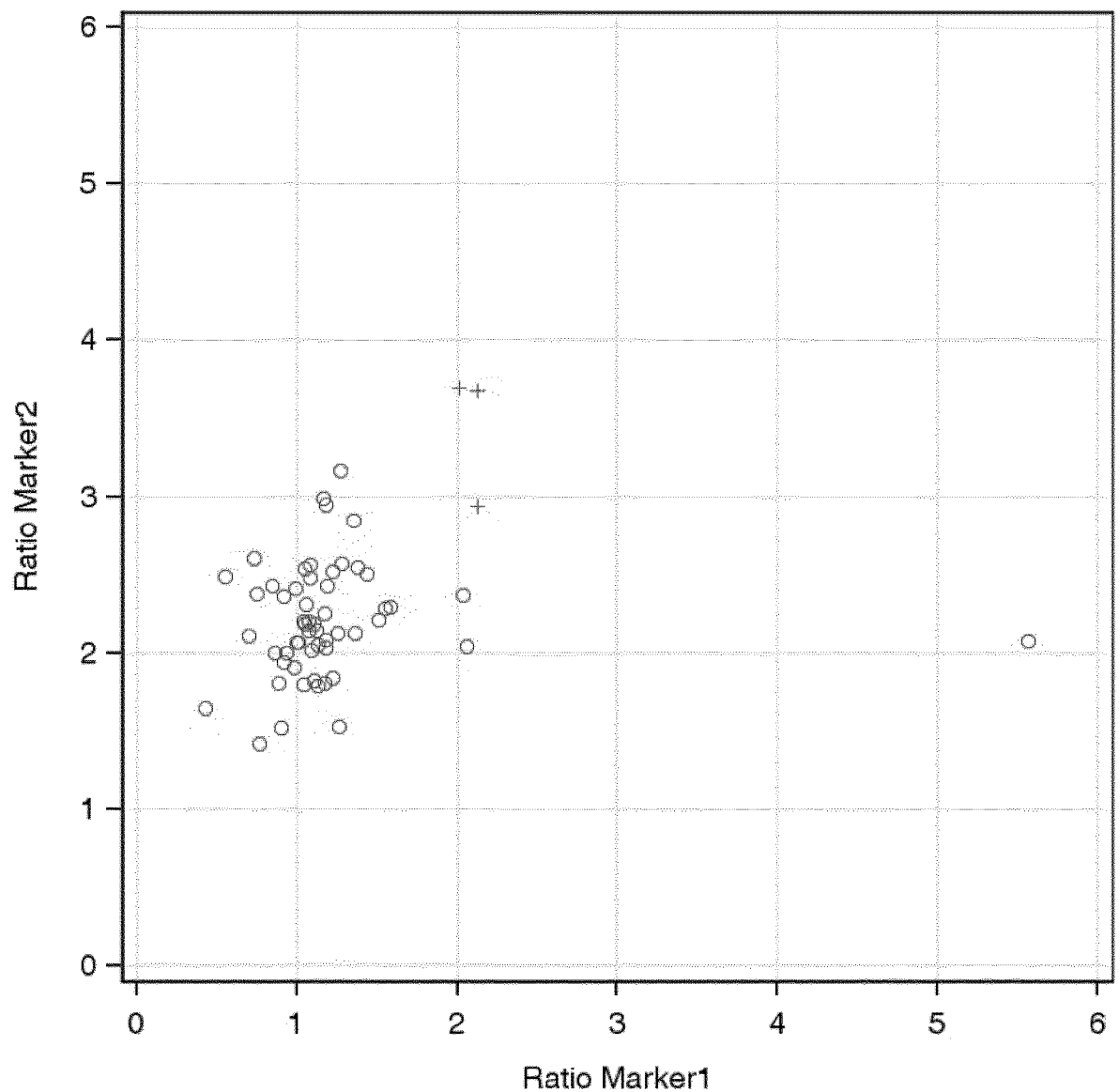

FIG. 7 depicts a scatter plot, for each sample from a first run of 59 samples, of the ratio of the amount of chromosome 21 (as determined by one target DMR located on chromosome 21) to the amount of reference chromosomes (5 and 12) [X-axis] against the ratio of the amount of chromosome 21 (as determined by the other target DMR located on chromosome 21) to the amount of reference chromosomes [Y-axis], wherein such amounts are determined by a method of the invention as described in EXAMPLE 4. Points representing women carrying a foetus with trisomy 21 (T21) are marked by "+", and are distinguishable from are the non-T21 samples.

Figure 8:
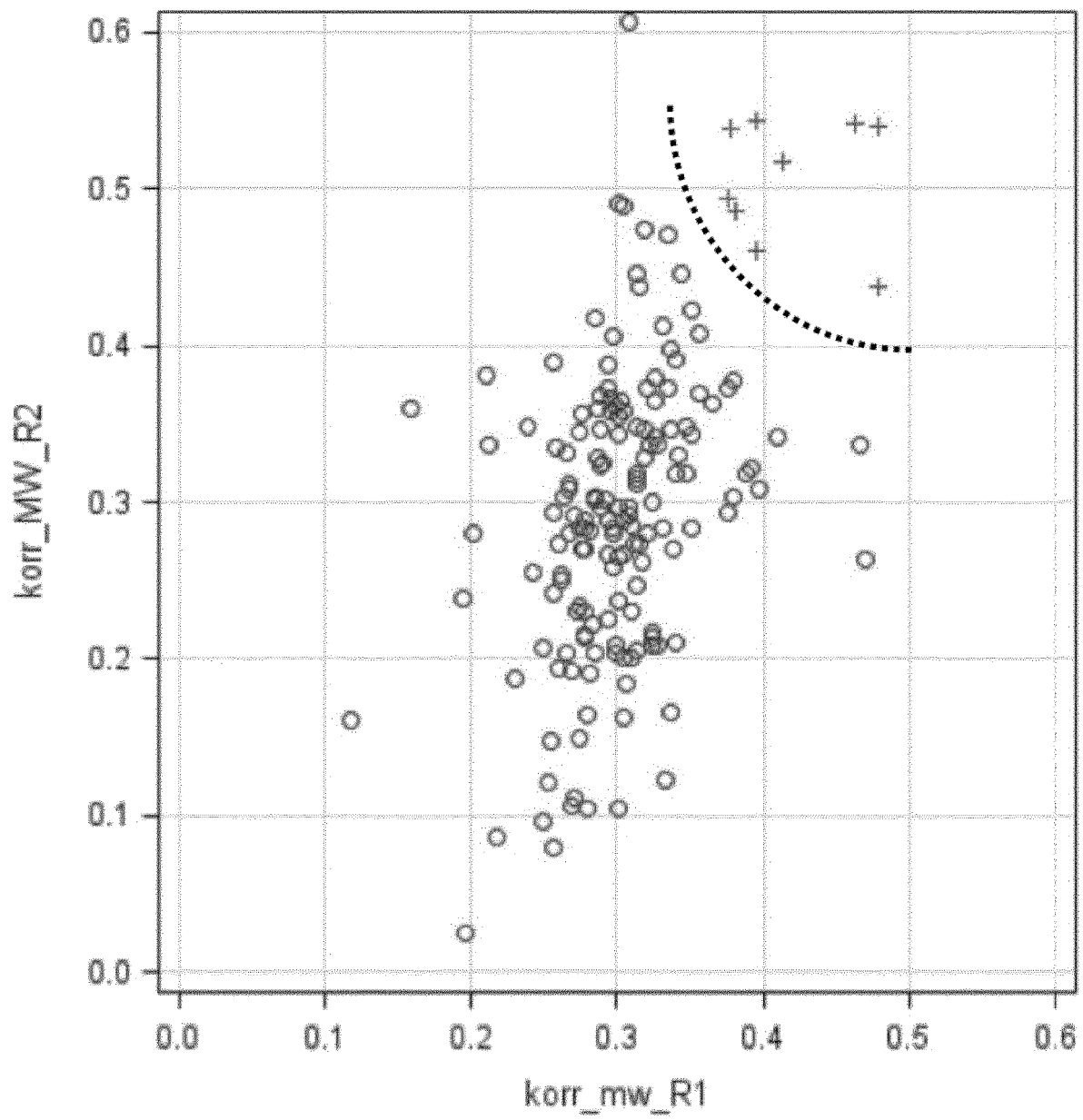

FIG. 8 depicts a scatter plot, for each sample from all three runs, totalling 168 samples, of the normalised ratio of the amount of chromosome 21 (as determined by one target DMR located on chromosome 21) to the amount of reference chromosomes (5 and 12) [X-axis] against the normalised ratio of the amount of chromosome 21 (as determined by the other target DMR located on chromosome 21) to the amount of reference chromosomes, wherein such amounts are determined by a method of the invention as described in EXAMPLE 4. Points representing women carrying a foetus with trisomy 21 (T21) are marked by "+", and are distinguishably clustered from the non-T21 samples, for example as demarcated by the dotted boundary shown. Note that the outlying non-T21 sample referred to in Example 4 lies outside the range of the X-axis (but not within the T21 cluster)

Figure 9:
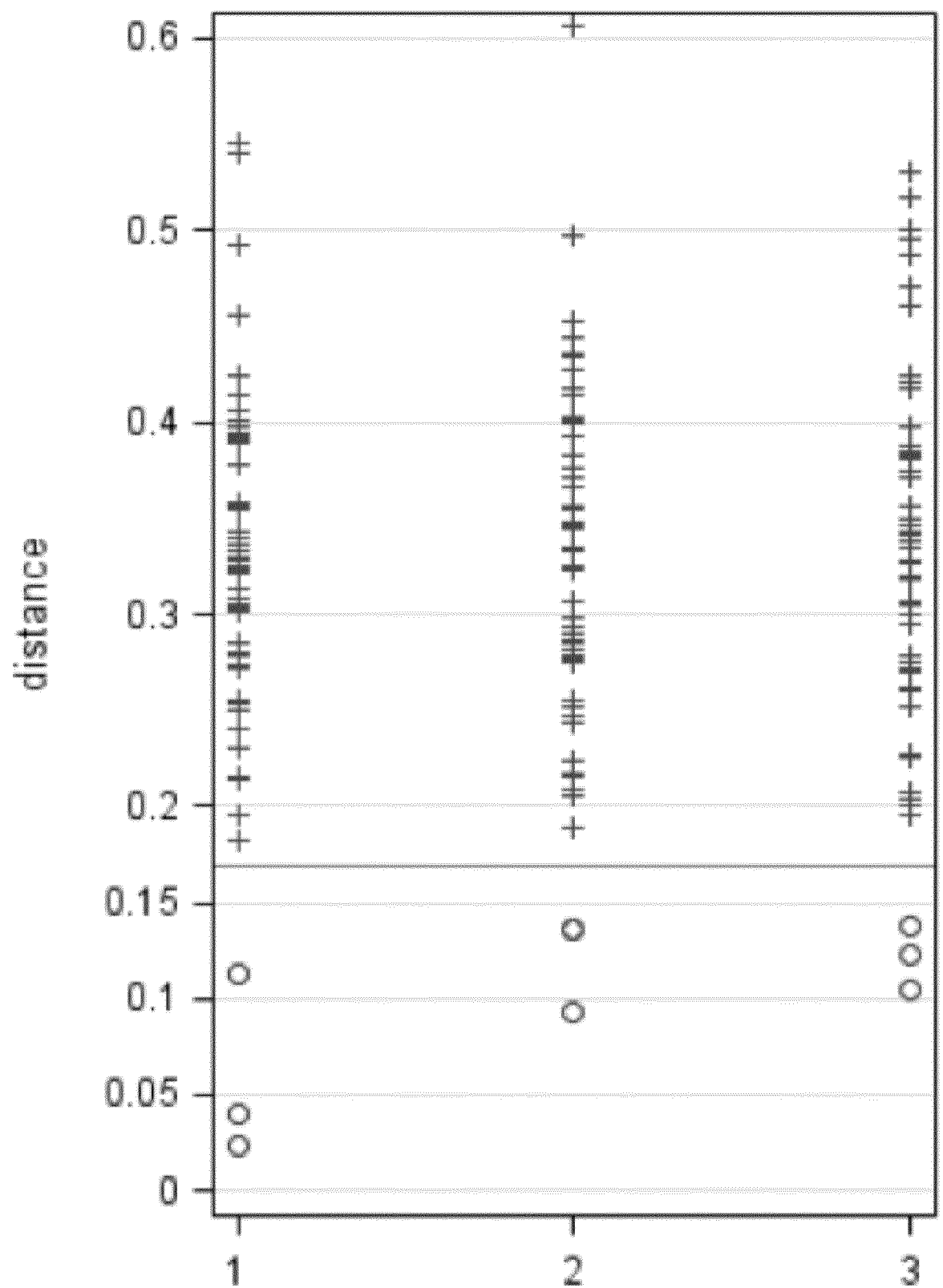

FIG. 9 depicts a scatter plot of the distance of each point from FIG. 8 from the centre point of the curved demarcation line (0.5,0.55) against the run number. Clear separation is show, across all runs, between the nine T21 samples (in this figure represented by "o") from the non-T21 samples (in this figure represented by "+").

Figure 10:
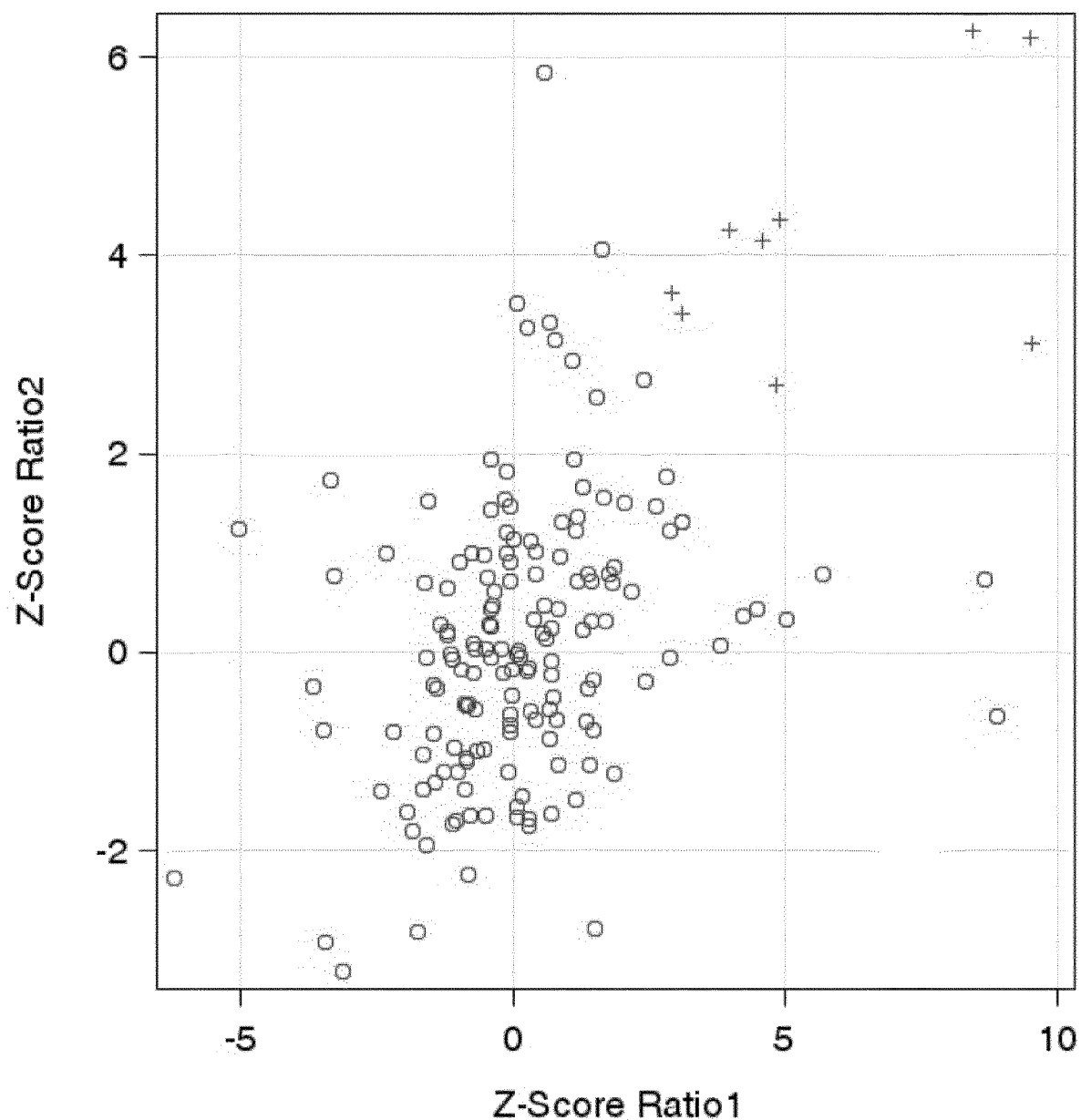

FIG. 10 depicts a scatter plot, for each sample from all three runs, totalling 168 samples, of the z-score for the ratio of the amount of chromosome 21 (as determined by one target DMR located on chromosome 21) to the amount of reference chromosomes (5 and 12) [X-axis] against the z-score for the ratio of the amount of chromosome 21 (as determined by the other target DMR located on chromosome 21) to the amount of reference chromosomes, wherein such amounts are determined by a method of the invention as described in EXAMPLE 4. Points representing women carrying a foetus with trisomy 21 (T21) are marked by "+", and are distinguishably clustered from the non-T21 samples. Note that the outlying non-T21 sample referred to in Example 4 lies outside the range of the X-axis (but not within the T21 cluster).

Figure 11:
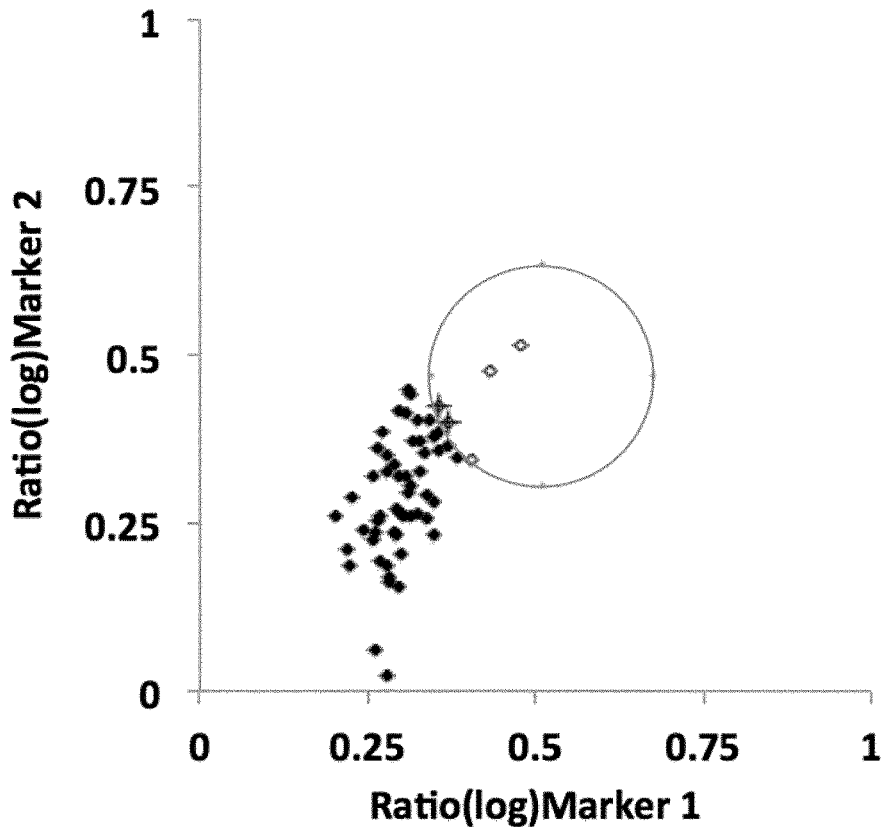

FIG. 11 depicts a scatter plot, for each sample from a qPCR run, totalling 58 samples (including 3 samples from women carrying a foetus with trisomy 21), of the normalised ratio of the amount of chromosome 21 (as determined by one target DMR located on chromosome 21: C21orf57) to the amount of reference chromosomes (5 and 12) [y-axis] against the normalised ratio of the amount of chromosome 21 (as determined by the other target DMR located on chromosome 21: DSCAM [x-axis]) to the amount of reference chromosomes, wherein such amounts are determined by a method of the invention as described by the assay described in EXAMPLE 4 (except as described in TABLE 6). Points representing women carrying a foetus with trisomy 21 (T21) are marked by an open square, and are distinguishably clustered from the non-T21 samples marked by a black square. Any false positives are marked by "+" and any false negatives by "X".

Figure 12:
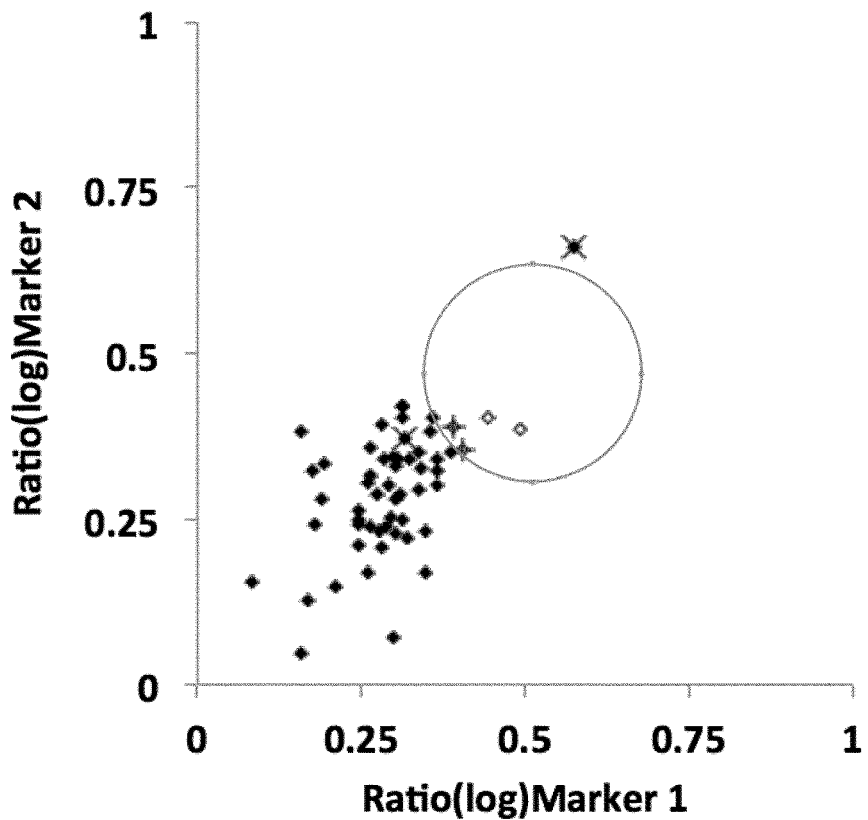

FIG. 12 depicts a scatter plot, for each sample from a qPCR run, totalling 56 samples (including 4 samples from women carrying a foetus with trisomy 21), described by assay V10.1 as described in EXAMPLE 10. Points defined as FIG. 11. As in FIG. 11, the y-axis chromosome 21 DMR is C21orf57, and the x-axis chromosome 21 DMR is DSCAM.

Figure 13:
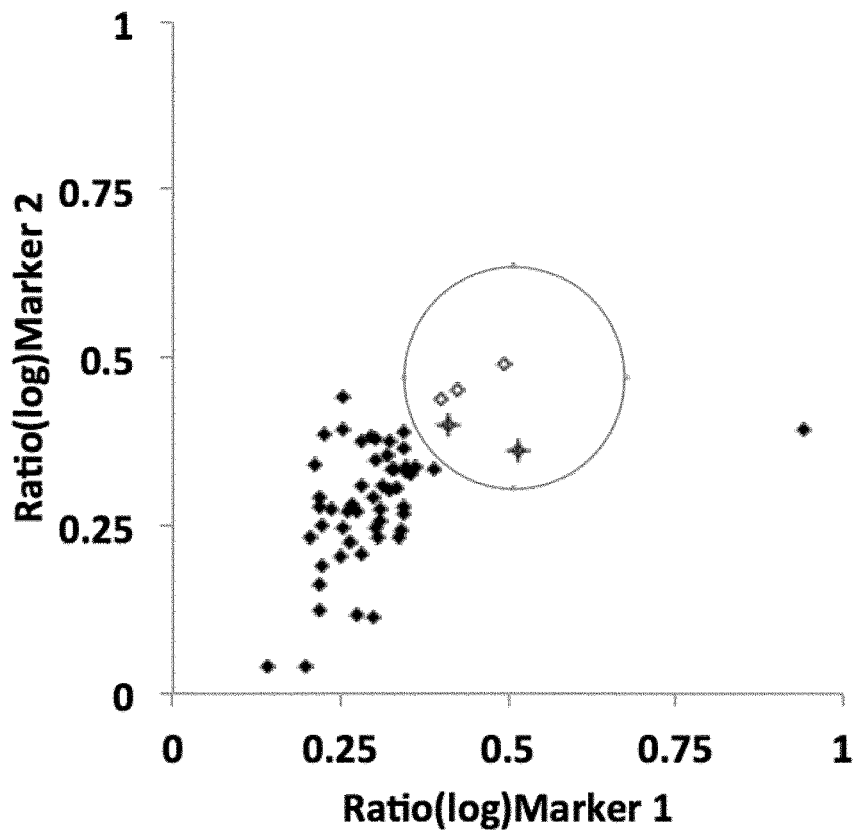

FIG. 13 depicts a scatter plot, for each sample from a qPCR run, totalling 58 samples (including 3 samples from women carrying a foetus with trisomy 21), described by assay V10.2 as described in EXAMPLE 10. Points defined as FIG. 11. As in FIG. 11, the y-axis chromosome 21 DMR is C21orf57, and the x-axis chromosome 21 DMR is DSCAM.

Figure 14:
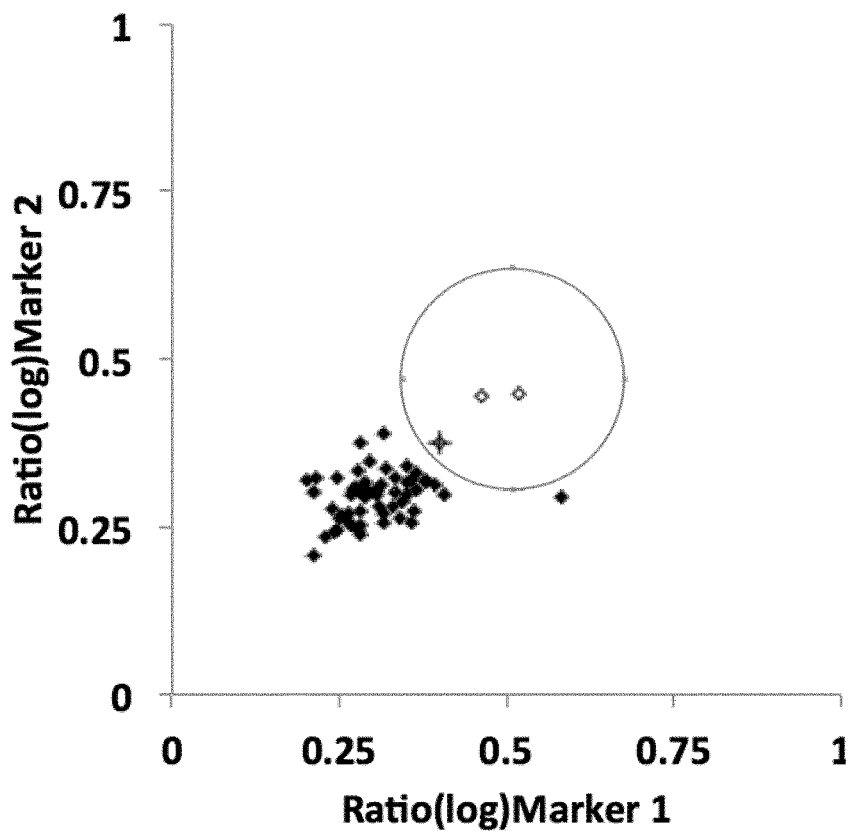

FIG. 14 depicts a scatter plot, for each sample from a qPCR run, totalling 58 samples (including 2 samples from women carrying a foetus with trisomy 21), described by assay V10.3 as described in EXAMPLE 10. Points defined as FIG. 11. As in FIG. 11, the y-axis chromosome 21 DMR is C21orf57, and the x-axis chromosome 21 DMR is DSCAM.

Figure 15:
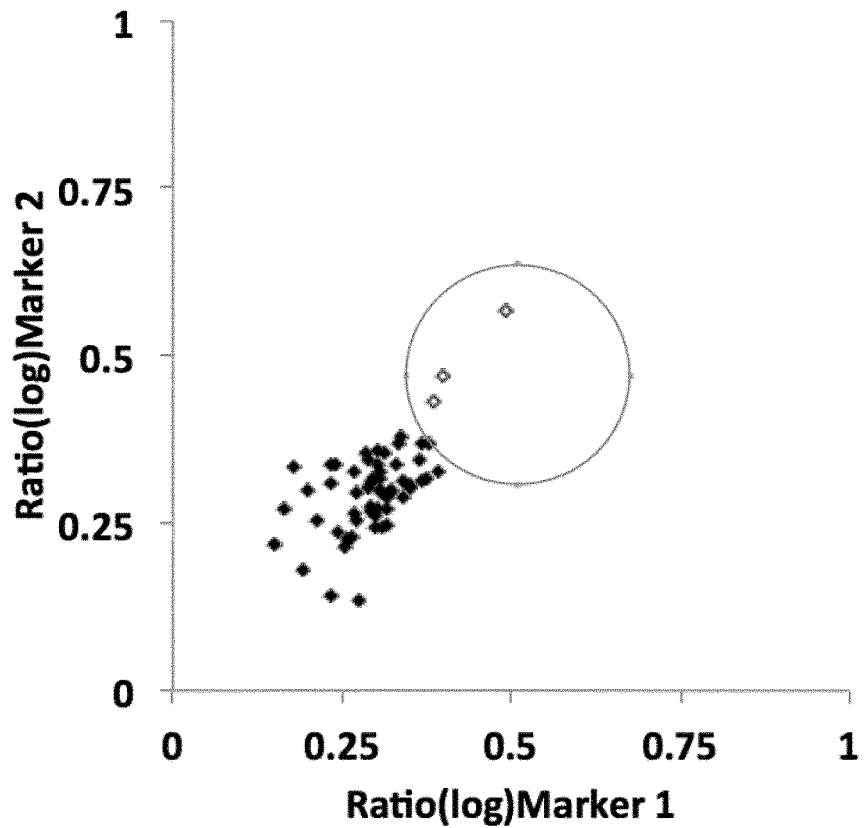

FIG. 15 depicts a scatter plot, for each sample from a qPCR run, totalling 58 samples (including 3 samples from women carrying a foetus with trisomy 21), described by assay V10.4 as described in EXAMPLE 10. Points defined as FIG. 11. As in FIG. 11, the y-axis chromosome 21 DMR is C21orf57, and the x-axis chromosome 21 DMR is DSCAM.

Figure 16:
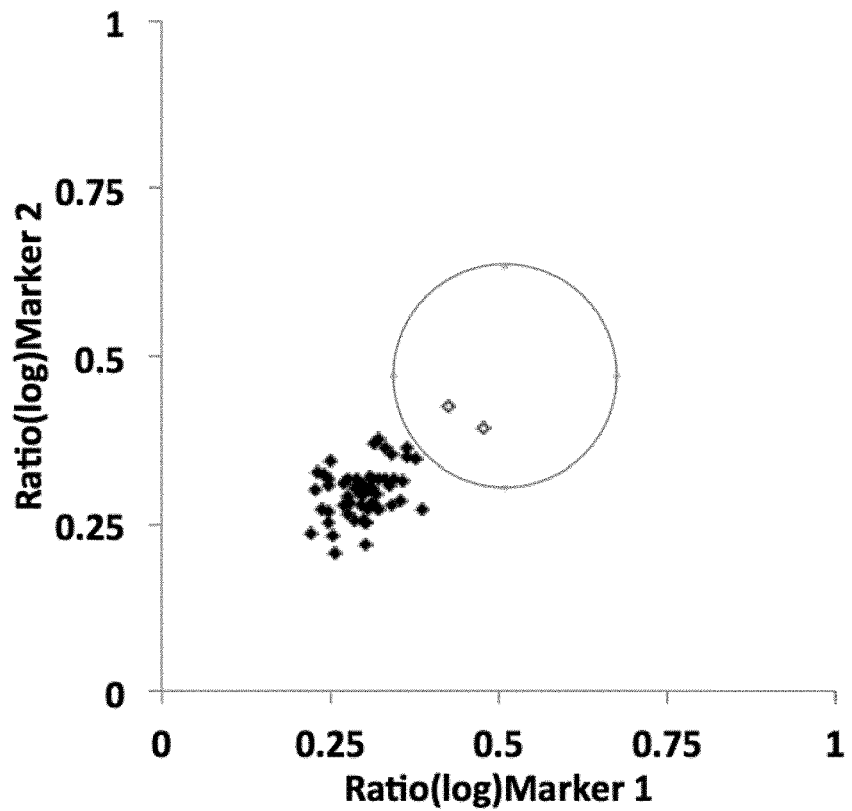

FIG. 16 depicts a scatter plot, for each sample from a qPCR run, totalling 58 samples (including 2 samples from women carrying a foetus with trisomy 21), described by assay V10.5 as described in EXAMPLE 10. Points defined as FIG. 11. In this assay, the y-axis chromosome 21 DMR is C21orf29, and the x-axis chromosome 21 DMR is DSCAM.

Figure 17:
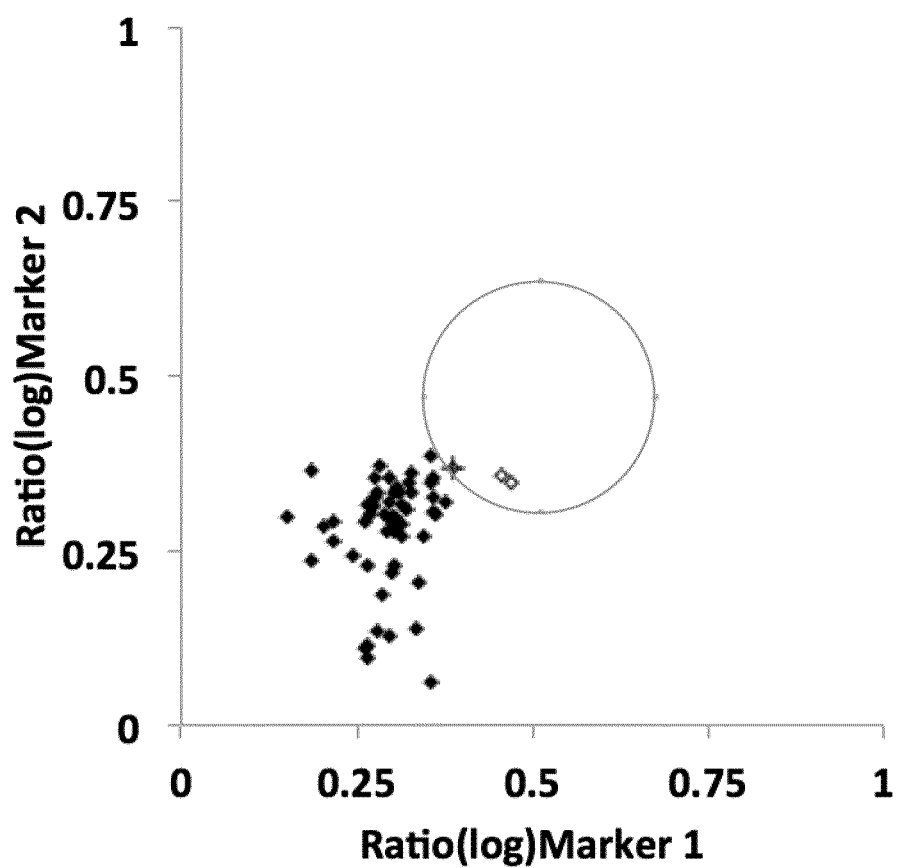

FIG. 17 depicts a scatter plot, for each sample from a qPCR run, totalling 58 samples (including 2 samples from women carrying a foetus with trisomy 21), described by assay V10.6 as described in EXAMPLE 10. Points defined as FIG. 11. In this assay, the y-axis chromosome 21 DMR is CGI149, and the x-axis chromosome 21 DMR is DSCAM.

The present invention, and particular non-limiting aspects and/or embodiments thereof, can be described in more detail as follows:

In a first aspect, and as may be further described, defined, claimed or otherwise disclosed herein, the invention relates to a method for detecting a chromosomal aneuploidy in a foetus carried by a pregnant female, said method comprising the steps:
(a) providing a sample taken from said pregnant female, which sample comprises DNA that originates from cells of a foetus and/or the placenta of a foetus in admixture with differently methylated DNA of maternal origin;
(b) treating the DNA present in said sample with a reagent that differentially modifies methylated and non-methylated DNA;
(c) determining an amount of a first target species of DNA, being the chromosome relevant to the chromosomal aneuploidy, in said sample by detecting in said sample the presence of methylation at two or more first target differentially methylated regions (DMRs) located on said chromosome, said first target DMRs differently methylated between DNA that originates from cells of a foetus and/or the placenta of a foetus and DNA of maternal origin, the modification of DNA of the first target DMRs by said reagent is sensitive to methylation of DNA, wherein a detected amount of methylated DNA at one or more of said first target DMRs indicates said amount of first target species of DNA in said sample;
(d) determining an amount of reference species of DNA, being one or more reference chromosomes, in said sample by detecting in said sample the presence of methylation at two or more reference DMRs located on said reference chromosome(s), said reference DMRs differently methylated between DNA that originates from cells of a foetus and/or the placenta of a foetus and DNA of maternal origin, the modification of DNA of such reference DMRs by said reagent is sensitive to methylation of DNA, wherein a detected amount of methylated DNA at one or more of said reference DMRs indicates said amount of reference species of DNA in said sample; and
(e) determining relative amount(s), preferable ratio(s), of an amount determined from step (c) and an amount determined from step (d), wherein one or more of said relative amount(s) indicates the presence or absence of the chromosomal aneuploidy in the foetus, preferably wherein, said detections in step (c) and step (d) are made using the same aliquot of DNA of said sample, and in the same vessel, and effectively simultaneously for said first target DMRs and said reference DMRs, and, optionally, using: (x) the same detectable labels(s) for at least two of said reference DMRs; and/or (y) a different detectable label(s) for at least two of said first target DMRs.

Terms as set forth herein are generally to be understood by their common meaning unless indicated otherwise. Where the term "comprising" or "comprising of" is used herein, it does not exclude other elements. For the purposes of the present invention, the term "consisting of" is considered to be a particular embodiment of the term "comprising of". If hereinafter a group is defined to comprise at least a certain number of embodiments, this is also to be understood to disclose a group that consists of all and/or only of these embodiments. Where used herein, "and/or" is to be taken as specific disclosure of each of the two specified features or components with or without the other. For example "A and/or B" is to be taken as specific disclosure of each of (i) A, (ii) B and (iii) A and B, just as if each is set out individually herein. In the context of the present invention, the terms "about" and "approximately" denote an interval of accuracy that the person skilled in the art will understand to still ensure the technical effect of the feature in question. The term typically indicates deviation from the indicated numerical value by ±20%, ±15%, ±10%, and for example ±5%. As will be appreciated by the person of ordinary skill, the specific such deviation for a numerical value for a given technical effect will depend on the nature of the technical effect. For example, a natural or biological technical effect may generally have a larger such deviation than one for a man-made or engineering technical effect. Where an indefinite or definite article is used when referring to a singular noun, e.g. "a", "an" or "the", this includes a plural of that noun unless something else is specifically stated.

In certain embodiments of the present invention, the pregnant female is a human or a non-human animal, where such non-human animal may, in particular embodiments, be selected from the group consisting of: horse, sheep, cow, pig, chicken, mouse and rat. In a more specific embodiment, the pregnant female may be suspected of being at increased risk of developing or suffering (or suffering from) a medical condition, such as one or more of the medical conditions disclosed herein. Such a method of the present invention is not intended to be practiced on the human or animal body; for example it is intended to be practiced in an in-vitro manner.

In certain embodiments of the present invention, said species of DNA and/or said differently methylated DNA is/are cell-free DNA, and in particular of such embodiments is/are circulating cell-free DNA. In one particular embodiment, said species of DNA and the differently methylated DNA that is admixed therewith are circulating cell-free DNA. The term "cell-free DNA" (or "cfDNA") is art recognised, and includes the meaning of DNA that is found outside of a cell, such as in a biological fluid (eg blood, or a blood fraction) of an individual. "Circulating" is also an art-recognised term, and includes the meaning that an entity or substance (eg cfDNA) is present in, detected or identified in, or isolated from, a circulatory system of the individual, such as the blood system or the lymphatic system. In particular, when cfDNA is "circulating" it is not located in a cell, and hence may be present in the plasma or serum of blood, or it may be present in the lymph of lymphatic fluid.

The term "differentially methylated region" or "DMR" will be recognised by the person of ordinary skill in the art, and is also intended to refer to a region in chromosomal DNA that is differentially methylated (eg at a CpG motif) between said (foetal) species of DNA and the other (maternal) DNA with which it is admixed in the sample. For example, the DMRs used in the present invention are differentially methylated between foetal and maternal DNA. In particular embodiments of the present invention, the DMRs are hypermethlyated in foetal DNA and hypo methylated in maternal DNA. That is, in such regions exhibit a greater degree (ie more) methylation in said (foetal) species of DNA as compared to the other (maternal) DNA, such as about 10%, 20%, 30%, 40%, 50%, 60%, 70%, 80%, 90% or 100% of, or more of, the sites available for methylation at a given DMR are methylated in said (foetal) species of DNA as compared to the same sites in the other (maternal) DNA. In particular embodiments, the region is less than about 10% methylated in maternal DNA and more than about 30% (such as more than about 50%) methylated in foetal DNA.

As will be understood by the person of ordinary skill, the term "an amount" can represent variables such as a concentration, a genomic equivalent, a molar number or a mass, as well as a value that is a surrogate for any of such variables. For example, a (quantitative) signal or measurement, such as one generated by analogue or digital (counting) quantification techniques, may also be a considered an "amount". In particular, for those embodiments of the methods of the present invention that use quantitative PCR, the amount may be represented by a measurement collected by the qPCR apparatus, such as a Ct (Threshold cycle) [also called Cp, Cross point cycle, for LightCycler terminology]: the cycle number at which the (fluorescence) signal from qPCR crosses a threshold. As will be understood by the person of ordinary skill, such Ct (or Cp) numbers inversely correlate with initial concentrations (amounts) of the DNA template being quantitated (eg the species of DNA that is differentially methylated).

In step (e) of the method of the present invention, the relative amount(s) of an amount determined from step (c) and an amount determined from step (d) is indicative of the presence or absence of the chromosomal aneuploidy in the foetus. For example, an excess or increase of the amount of the (first) target species of DNA (being the chromosome relevant to the chromosomal aneuploidy) compared that which would be expected for a euploid sample (eg, by comparison to the amount of reference species of DNA, being one or more reference chromosomes) represents that an excess amount of the target species of DNA is present and indicates that a partial or complete extra copy of the chromosome relevant to the chromosomal aneuploidy is present in the foetus. In particular, such an excess of an amount of target species of DNA can indicate a partial or complete chromosomal trisomy, such as human trisomy 21 (T21). In a contrasting example, a deficient or a reduction of the amount of the (first) target species of DNA (being the chromosome relevant to the chromosomal aneuploidy) compared that which would be expected for a euploid sample (eg, by comparison to the amount of reference species of DNA, being one or more reference chromosomes) represents that a reduced amount of the target species of DNA is present and indicates that all or part of at least one copy of the chromosome relevant to the chromosomal aneuploidy is absent in the foetus. In particular, such a reduced amount of target species of DNA can indicate a partial or complete chromosomal loss (eg a monosomy), such as Turner syndrome (45,X).

The amounts determined from step (c) and an amount determined from step (d) can be compared from a theoretical perspective. For example, for a human trisomy (such as T21, T18 and/or T13), the amount of the (first) target species of DNA (being the chromosome relevant to the chromosomal aneuploidy) should theoretically have a ratio of amounts equivalent to 3:2 compared to the amount of reference species of DNA (being one or more reference chromosomes). However, with differences in detection sensitivities and quantification for different regions of target and/or reference chromosomes (and/or DMRs), such theoretical ratios may not be achievable in practice. Accordingly, the presence of the chromosomal aneuploidy in the foetus may be indicated where an amount determined from step (c) is not equivalent to an amount determined from step (d), where equivalence of the amounts does not mean that they have the same value. Indeed, the presence of the chromosomal aneuploidy in the foetus may be indicated by a difference in, distortion of or otherwise a bias in the amount determined from step (c) compared to that expected for a euploid foetus, such as from the amount determined from step (d).

As will be appreciated by the person of ordinary skill, a definitive indication of the presence (or absence) of the chromosomal aneuploidy in the foetus may not be possible in all circumstances or samples. Accordingly, the present invention also envisions methods whereby in step (e) the indication of the presence (or absence) of the chromosomal aneuploidy in the foetus is represented as a likely or as a possible presence (or absence) rather than a definitive indication. Such envisioned methods include embodiments wherein said method includes an additional step of signalling or flagging that an additional diagnostic test is conducted to provide more certainty, confidence or a definitive diagnosis. Such a subsequent test may include a different NIPT for the detection of foetal aneuploidy (such as NGS-based NIPT as described in EXAMPLE 1) and/or may include CVS or amniocentesis.

In certain embodiments of such method of present invention, said detections in step (c) and step (d) are made using: (x) the same detectable labels(s) for at least two of said reference DMRs; and (y) a different detectable label(s) for at least two of said first target DMRs; and in particular of such embodiments, said detections in step (c) and step (d) are made using: (x) the same detectable labels(s) for each of said at least two reference DMRs; and (y) a different detectable label(s) for each of said at least two first target DMRs.

In alternative embodiments of such method of present invention, said detections in step (c) and step (d) are made using: (x) the same detectable labels(s) for at least two of said first target DMRs; and/or (y) a different detectable label(s) for at least two of said reference DMRs; and in particular of such embodiments, said detections in step (c) and step (d) are made using: (x) the same detectable labels(s) for each of said at least two first target DMRs; and (y) a different detectable label(s) for each of said at least two reference DMRs.

In a further alternative embodiments of such method of present invention, said detections in step (c) and step (d) are made using: (x) the same detectable labels(s) for at least two (preferably each) of said reference DMRs; and (y) the same detectable labels(s) for at least two (preferably each) of said first target DMRs, wherein the detectable labels(s) used for (x) is/are different to the detectable labels(s) used for (y).

In alternative embodiments of such method of present invention, said detections in step (c) and step (d) are made using: (x) a different detectable labels(s) for at least two (preferably each of said first target DMRs; and/or (y) a different detectable label(s) for at least two (preferably each of said reference DMRs.

In particular certain embodiments a different detectable label(s) is/are used for such first target DMRs and as is/are used for the reference DMRs and, if OR(s) are used in the method, as is/are used for such OR(s).

In certain embodiments of the present invention, in step (c) more than two first target DMRs may be used. For example, three, four, five, six, seven, eight, nine or more than nine first target DMRs may be used (such as about 10, 15, 20, 30, 50 or more than 50 of such first target DMRs). In those embodiments of the invention where a different detectable label(s) used for at least two of said first target DMRs, then one or more (preferable two, three, four, five or more than five) of the other first target DMRs may be detected using a further different detectable label(s). Alternatively, a different detectable label(s) used for at least two of said first target DMRs, and one or more (preferable two, three, four, five, six, seven, eight or more than eight) of the other first target DMRs may have the same detectable label(s) used for one of said two of said first target DMRs. For example, two first target DMRs may have the same detectable label(s) and a two further first target DMRs may have a different detectable label(s). Such embodiments may provide further advantages to the present invention, such as providing yet further increased sensitivity of specificity without having to resort to additional detectable labels; the number of which may be practically limited given expenses and technical demands of multi-channel detection equipment and eg for fluorescent labels the overlap of detection spectra and colour bleaching.

A reagent is used in the present invention that differentially (eg selectively) modifies methylated as compared to non-methylated DNA. For example, treatment of DNA with a reagent comprising bisulphite (bisulfite) converts cytosine residues to uracil, but leaves 5-methylcytosine residues unaffected. Thus, bisulphite treatment introduces specific changes in the DNA sequence that depend on the methylation status of individual cytosine residues, yielding single-nucleotide resolution information about the methylation status of a segment of DNA. Various analyses can be performed on the altered sequence to retrieve this information, including the use of PCR primers and/or probes that can distinguish between such singe-nucleotide changes.

Such a reagent may alternatively (or in addition) comprise a restriction enzyme that is sensitive to the DNA methylation states. Cleavage of such a restriction enzyme's recognition sequence may be blocked, or impaired, when a particular base in the enzyme's recognition site is modified, eg methylated. In particular embodiments of all aspects of the invention, the reagent comprises a methylation-sensitive restriction enzyme, such as a methylation-sensitive restriction enzyme disclosed herein; including such embodiments that comprise two, three, four, five or more of such methylation-sensitive restriction enzymes.

Prior to step (b), the sample may be processed to isolate, enrich and/or purify, the DNA present therein. For example, a plasma sample may be processed using a cfDNA isolation process or kit to provide a (non-natural) subsequent solution that comprises an admixture of said species of DNA together with the differentially methylated DNA (eg of maternal origin) that does not originate from the foetus and/or the placenta of the foetus. The step of treating in (b) may comprise the step of adding a separate solution that comprises said reagent (eg a methylation sensitive restriction enzyme) to the admixed DNA of the sample (eg, to a non-natural solution comprising such admixed DNA); and/or may comprise maintaining (or changing to) certain conditions. In particular, when said reagent comprises one or more methylation sensitive restriction enzyme, the step of treating in (b) may comprise incubating the DNA and the enzyme(s) together at about 37° C. for between about 5 min and 300 min, such as between about 30 min and 90 min or about 60 min, and optionally may comprise a step of incubating such mixture at a higher temperature (for example, between about 50° C. and 90° C., such as about 80° C.) so as to deactivate the enzyme(s). In certain embodiments, the composition formed for a treating step of (b) may be non-naturally occurring. For example, particular salts of components of the solution (or buffer); and/or the mixture of (eg human) cfDNA together with one or more bacterial-derived restriction enzymes (or a non-natural mutant thereof) may be a non-natural composition or mixture. Furthermore, any of the methods of the present invention may produce (and hence a composition of the present invention may comprise) an in-vitro-produced nucleic acid molecule, such as a DNA product of a PCR reaction (eg a "PCR product"). One or more of such in-vitro-produced nucleic acid molecules may be non-natural because they comprise a nucleotide primer and/or probe that includes at least one detectable label, such a nucleic acid molecule having been generated by polymerase extension (or partial nuclease digestion) of such a labelled primer and/or probe, and hence providing at least a fraction of such nucleic acid molecules that include a detectable label, such that even though the nucleic acid sequence of the nucleic acid molecules may comprise a naturally occurring sequence (or fragment thereof), such an in-vitro-produced nucleic acid molecule is non-natural by virtue of (at least) the non-natural detectable label that it includes. In particular embodiments, prior to step (b), the sample taken from said pregnant female may be processed to extract DNA present in said sample; for example, said processes may extract total cell-free DNA from said sample, or said processes may extract and/or enrich for foetal cell-free DNA.

In certain embodiments of the method of the present invention, the relative amount(s) or ratio(s) determined in step (e) are compared with threshold(s) and/or reference distribution(s), wherein one or more (preferably two or more) of said relative amount(s) or ratio(s) higher or lower than said threshold(s) and/or reference distribution(s) indicates the presence of the chromosomal aneuploidy in the foetus. The threshold(s) and/or reference distribution(s) may come from prior studies, including those of control samples, or they may be generated from a plurality of samples analysed by a method of the invention. For example, if a number of different samples (such as about 10, 20, 30, 40, 50, 60, 80, 90, 10, 120, 150, 175, 200, 250, 500 or more than about 500 samples; in particular, about 60 sample, and more particularly over 500 samples) are so analysed, and one or other individual samples show an amount from (c) or a relative amount from (e) that is an outlier to the population of analogous amounts from most other samples, then this indicates that the foetus carried by the pregnant female from which the individual sample was taken has a chromosomal aneuploidy. As described above, it will be appreciated that even if the relative amount(s) or ratio(s) determined in step (e) are compared with threshold(s) and/or reference distribution(s), a definitive indication of the presence (or absence) of the chromosomal aneuploidy in the foetus may not be possible in all circumstances or every sample. Accordingly in such embodiments of the present invention, also include those where a likely or possible presence (or absence), rather than a definitive indication, of the chromosomal aneuploidy is indicated, including those embodiments that include an additional step of signalling or flagging that an additional diagnostic test is conducted to provide more certainty or a definitive diagnosis. Exemplary additional diagnostic tests include any of those are described elsewhere herein, in particular such as NGS-based NIPT as described in EXAMPLE 1.

An indication that the chromosomal aneuploidy is present in the foetus may instead or additionally be assessed by considering: (i) the increase (or decrease) of a measure or signal representing an amount of the first target species of DNA (such as one determined from one or other of the first target DMRs) compared to that expected in relation to a measure or signal representing an amount of the reference species of DNA (such as one determined from the reference DMRs); and/or (ii) into which a measure or signal representing an amount of the first target species of DNA (such as one determined from one or other of the first target DMRs) determined from the sample falls, from consideration of a reference distribution.

In certain embodiments, the threshold amount(s) may be established by a standard control; for example, established experimentally from a known sample (or a plurality of known samples) once or separately, and/or a threshold amount(s) that is established (eg a from a sample or plurality of known samples) at about the same time as the test sample (or test samples), such as in the same run, in particularly by establishing the threshold amount(s) by practicing a method of the present invention on samples contained in wells of a microtiter plates where one or more known samples placed in one or more (separate) wells and one or more test samples placed in other wells. In other embodiments of the present invention, a comparison with a threshold amount and/or reference distribution of amounts is made from the relative amount (such as the ratio of) an amount of the first (or second) target species of DNA (ie, a chromosome relevant to the chromosomal aneuploidy) to an amount of the reference species of DNA (ie, the reference chromosome). For example, from a theoretical perspective an amount of the first target species of DNA originating from a normal diploid set of human chromosomes 21 would be expect to show about a 2:2 (ie 1:1) ratio to the amount of the reference species of DNA originating from a reference (diploid) set of eg chromosome 2. However, in the event of trisomy 21, such a ratio would be expected to be about 3:2. As will now be understood by the person of ordinary skill, other chromosomal (or partial chromosomal) aneuploidies would be expect to show other theoretical ratios, for example 1:2 in the case of a loss of a complete chromosome, or a partial loss such as a partial deletion of the location of the first species of DNA, compared to the reference chromosome comprising the location of the second species of DNA. In certain embodiments, eg if not differentiated such as by methylation differences, the presence of other DNA (ie in a mixture with such other DNA) such as euploid maternal cfDNA in admixture with aneuploid foetal cfDNA could result in modified such ratios depending on the relative amounts of (euploid) maternal and (aneuploid) foetal cfDNAs. As will also be understood by the person or ordinary skill, modified such ratios may result from other factors such as the relative reaction (eg PCR reaction) efficiency of each amplicon. Accordingly, in certain of such embodiments, the threshold amount is a ratio that is (detectably and/or significantly) greater or smaller than 2:2 (100%) such as about 3:2 (150%), about 2:3 (66%), about 1:2 (50%) or about 2:1 (200%); including threshold amounts and/or ratios that are greater than about 200%, less than about 50%, or is one selected from the list consisting of about: 190%, 180%, 170%, 160%, 150%, 140%, 130%, 120%, 110%, 105%, 95%, 90%, 85%, 80%, 75%, 70%, 65%, 60%, and 55%. Alternatively, in particular embodiments, the threshold amount may be determined merely by there being no detectable amount of the first (or second) species of DNA, such as in Turners syndrome (a human female with a "45, X" karyotype rather than the fully euploid "46,XX" karyotype). However, as described above, differences in detection sensitivities and quantification for different regions of target and/or reference chromosomes (and/or DMRs), such theoretical ratios may not be achievable in practice. Accordingly, the presence of the chromosomal aneuploidy in the foetus may be indicated where an amount determined from step (c) is not equivalent to an amount determined from step (d), where equivalence of the amounts does not mean that they have the same value. Indeed, the presence of the chromosomal aneuploidy in the foetus may be indicated by a difference in, distortion of or otherwise a bias in the amount determined from step (c) compared to that expected for a euploid foetus, such as from the amount determined from step (d).

In certain embodiments, a parameter (such as a mean, median, standard deviation, median absolute deviation or z-score) is calculated in respect of a set of samples within each run, plate or detection/analysis data-set. In certain of such embodiments, such a calculated parameter is used to identify outliers (such as trisomy samples) from those test samples detected/analysed in such run, plate or data-set (eg, a "run-specific" analysis). In particular embodiments, such a parameter is calculated from all test samples without knowledge of the identity of any outliers (eg a "masked" analysis). In other particular embodiments, such a parameter is calculated from a set of reference samples know to be (non-outlying) standards (such as samples known to contain cfDNA from euploid foetuses) or test samples that are presumed to be (or are unlikely to be) such standards.

Comparing and detecting differences between sample distributions and reference distributions, or sample outliers from reference distributions will be known to the person of ordinary skill, and include the use of parametric and non-parametric statistical testing such as the use of (one- or two-tailed) t-tests, Mann-Whitney Rank Sum test and others, including the use of a z-score, such as a Median Absolute Deviation based z-score (eg, such as used by Stumm et al 2014, Prenat Diagn 34:185). When comparing a distribution to (or outliers from) a reference distribution, then in certain embodiments of the invention, the comparison is distinguished (and/or identified as being significantly different) if the separation of the means, medians or individual samples are greater than about 1.5, 1.6, 1.7, 1.8, 1.9, 1.95, 1.97, 2.0, or greater than about 2.0 standard distributions ("SD") of the reference distribution; and/or if an individual sample separates from the reference distribution with a z-score of greater than about 1.5, 1.6, 1.7, 1.8, 1.9, 2.0, 2.5, 2.7, 2.8, 2.9, 3.0, 3.1, 3.2, 3.3, 3.4, 3.5, 3.75, 4.0, 4.5, 5.0 or greater than about 5.0.

In certain embodiments, in the context of a data set a z-score (or an equivalent statistic based on the distribution pattern of replicates of a parameter) may be calculated to identify an outlying data point(s) (for example, representing an excessive amount of the species of DNA such as in the context of a test seeking to identify a pregnant female predicted to have or having an increased risk of suffering or developing preeclampsia, or representing an excessive amount of one chromosome over a reference chromosome such as in the context of a test seeking to identify a foetus suffering from a chromosomal aneuploidy), the data representing such data point removed from the data set and a subsequent z-score analysis be conducted on the data set to seek to identify further outliers. Such an iterative z-score analysis may be particular helpful in detection of foetal chromosomal aneuploidies using a method of the present invention, where sometimes two or more aneuploidy samples in one run may skew a single z-score analysis, and/or where follow-up tests are available to confirm false positives and hence avoiding false negatives is potentially more important that the (initial) identification of false positives.

The practice of the method of the present invention can enable the relative detection (or amount) of the first (or second) target species of DNA (eg, from a chromosome, or part thereof, related to a chromosomal aneuploidy such as human chromosome 21) and reference species of DNA (for example, from a reference chromosome, or part thereof, such as chromosome 12, 5 or 2), and hence aid the rapid, simple and cost-effective detection, identification or diagnosis of a chromosomal aneuploidy in a foetus. Such an approach may be more easily established and practiced in many laboratories, requiring for example, a relatively simple, reliable and cost-effective quantitative PCR machine; and not requiring expensive and specialised high-throughput next-generation sequencing machines. Indeed, in certain of such embodiments of the present invention, detection in step (c) of said first target DMRs and said detection in step (d) of said reference DMRs are made using the same aliquot of DNA of said sample, and in the same reaction/detection vessel, and effectively simultaneously for such DMRs, and using: (x) the same detectable labels(s) for at least two (preferably each) of said reference DMRs; and (y) a different detectable label(s) for at least two (preferably each) of said first target DMRs. The relative detection, identification or quantification of the first (or second) target and reference species of DNA (via the target DMRs and the reference DMRs) is, in those embodiments conducted in the same reaction/detection vessel and effectively simultaneously, advantageously may be made by the use of detectable labels that can distinguish at least two of the first (or second) target DMRs from the reference DMRs and, if used, their corresponding ORs detected in optional step (f). In a particular further such embodiment where detection (c) and (d) is conducted in the same reaction/detection vessel and effectively simultaneously includes where said detection in step (c) and said detection in step (d) are made by multiplex real-time quantitative probe-based PCR using at least one labelled probe specific for each of said DMRs and, if used, each OR.

In all aspects of the present invention, embodiments are included when the presence of the chromosomal aneuploidy is a total or partial such aneuploidy, for a chromosomal abnormality that is associated with a foetal abnormality and/or congenital disorder. For example, such a chromosomal abnormality may be selected from the group consisting of: a trisomy (such as trisomy 21, trisomy 18, or trisomy 13), a sex-chromosome abnormality (such as Turners syndrome, Klinefelter syndrome, [Noonan syndrome,] Triple X syndrome, XXY syndrome, or Fragile X syndrome or XYY syndrome or XXYY syndrome), a chromosomal deletion (such as Prader-Willi syndrome, Cris-du-chat syndrome, Wolf-Hirschhorn syndrome, or 22q11 deletion syndrome, Duchene muscular dystrophy), Beckwith-Wiedemann syndrome, Canvan syndrome, and neurofibromatosis. Of most relevance, in terms of prevalence and hence medical and social significance is where such chromosomal abnormality is a trisomy, such as one selected from the list consisting of trisomy 21, trisomy 18, or trisomy 13.

In those embodiments of the present invention in which the pregnant female is human, the chromosome relevant to the chromosomal aneuploidy may be a human chromosome selected from the list consisting of: chromosome 21, chromosome 18, chromosome 13, X-chromosome and Y-chromosome, preferably chromosome 21, chromosome 18, chromosome 13. In particular of such embodiments, the chromosome relevant to the chromosomal aneuploidy is human chromosome 21. In certain of any of such embodiment, said chromosomal aneuploidy may be an aneuploidy of said chromosome. In all aspects of the present invention, the chromosomal aneuploidy is a monosomy or a trisomy of said chromosome, which as will be known by the person of ordinary skill, may be a partial or complete aneuploidy such as a partial or complete monosomy or trisomy of said chromosome, in which a "partial" aneuploidy includes the meaning of an imbalance of genetic material caused by loss or gain of part of a chromosome. For example, a partial aneuploidy may include the situation of an unbalanced translocation, where an individual carries a derivative chromosome formed through the breakage and fusion of two different chromosomes. In this example, the individual would have three copies of part of one chromosome (two normal copies and the portion that exists on the derivative chromosome) and only one copy of part of the other chromosome involved in the derivative chromosome.

Correspondingly in those embodiments of the present invention in which the pregnant female is human, one or more of the reference chromosome(s) may be one selected from the list consisting of: human chromosome 1, 2, 3, 4, 5, 6, 7, 8, 9, 10, 11, 12, human chromosome 14, 15, 16, 17, human chromosome 19, human chromosome 20 human chromosome 22 and human chromosome 23. In particular of such embodiments, the reference chromosome is human chromosome 5 or human chromosome 12.

In certain embodiments of the present invention, two or more of said reference DMRs are located on different reference chromosomes. For example, in certain embodiment, one of said reference DMR is located on human chromosome 5 and another of said reference DMR is located on human chromosome 12.

However, also encompassed within the scope of the present invention are embodiments where one (or more) of the chromosomes used as the reference chromosome is a chromosome which may be associated with a chromosome aneuploidy but a different chromosome to that relevant to the chromosomal aneuploidy for which the detection method is being applied. For example, if the method of the present invention is being practiced to detect trisomy 21 in a foetus carried by a pregnant human female, then for example human chromosome 18 or human chromosome 13, in particular chromosome 13, may be used as a "reference" chromosome. In such an example, given the negligible likelihood of the foetus carrying both a trisomy 21 and a trisomy 13, an excess of chromosome 21 compared to chromosome 13 would indicate a trisomy of chromosome 21. Correspondingly, by use of the same assay but now instead consideration of the chromosome 13 as the being the chromosome relevant to the chromosomal aneuploidy for which the detection method is being applied, then an excess of chromosome 13 compared to chromosome 21 (equivalent to a reduction in chromosome 21 compare to chromosome 13) would indicate a trisomy of chromosome 13. Such a selection of "reference" chromosomes and practice/consideration of the methods of the present invention would have particular advantages of providing the possibility to detect the presence (or absence) of an aneuploidy at more than one chromosome relevant to a chromosomal aneuploidy in a single assay. Such an assay would not only save time and cost, but would may also enable the detection of the presence of such more than one chromosomal aneuploidy from a single sample; which given the relatively low level of foetal-derived DNA typically present in a maternal sample, would then require fewer sampling or less sample taken from the pregnant female.

In particular embodiments, the inventive method further comprises the step of:

(f) determining an amount of total DNA in said sample by detecting at least one other region (OR) that is not differently methylated between DNA that originates from cells of a foetus and/or the placenta of a foetus and DNA of maternal origin, the modification of which OR(s) by said reagent is insensitive to methylation of DNA, preferably wherein, said detections in step (c) and step (d) and step (f) are made using the same aliquot of DNA of said sample, and in the same vessel, and effectively simultaneously for said first target DMRs and said reference DMRs and said other region(s), and, in one embodiment, using: (x) the same detectable labels(s) for at least two (preferably each) of said reference DMRs; and/or (y) a different detectable label(s) for at least two (preferably each) of said first target DMRs and for at least one (preferably each) of said OR(s). In alternative embodiments, detections in step (c) and step (d) and step (f) may be made using: a different detectable label(s) for at least two (preferably each) of said reference DMRs, for at least two (preferably each) of said first target DMRs and for at least one (preferably each) of said.

In contrast to DMRs, an "other region" ("OR"), if used in the present invention, is not (significantly) differentially methylated between the species of DNA that originates from cells of a foetus and/or the placenta of a foetus and DNA of material origin with which it is admixed in the sample. For example, under the conditions and nature of the reagent used, there is no detectable difference between modification by such reagent at the other region of said species of (foetal) DNA) as compared to the other region of the admixed (maternal) DNA. Such a non-difference may be achieved if the other region comprises no sites for methylation, if there is no difference in the degree of methylation if such sites are present, or by the use of a reagent that does not recognise any sites of methylation present in the other region. Accordingly, in alternative embodiments of the present invention, the at least one OR used in optional step (f) is one for which no (significant) difference in methylation between said species of (foetal) DNA and the other (maternal) DNA is (or can be) recognised or detected (or recognisable or detectable) with said reagent.

In certain embodiments of the present inventive method, said OR(s) is(are) located on one or more reference chromosome(s). One or more of said reference chromosome(s) may, in the case of a pregnant human female, be one selected from the list consisting of: human chromosome 1, 2, 3, 4, 5, 6, 7, 8, 9, 10, 11, 12, human chromosome 14, 15, 16, 17, human chromosome 19, human chromosome 20 human chromosome 22 and human chromosome 23. In particular of such embodiments, the reference chromosome is human chromosome 5 or human chromosome 12. In certain particular embodiments, at least one of said ORs may be located on the same reference chromosome(s) as at least one of said reference DMRs, for example one of said reference DMRs and one of said ORs may be both located on human chromosome 5 or human chromosome 12. In other embodiments, said OR(s) is(are) located on a chromosome(s) relevant to a chromosomal aneuploidy.

The OR(s) (that is/are not so differentially methylated), if used in the present invention, may be non-overlapping with one or more of the (eg reference) DMRs used in the present invention. For example, an OR can be located further than about 10 bp, 20 bp, 50 bp, or more than 100 bp, 500 bp, 1 kb or 10 kb, away from one (or all) of the (eg reference) DMRs, such as is located between about 20 bp and about 20 kb upstream or downstream of (including embodiments being located within the same gene as) said (eg reference) DMR. In particular, the genomic location of the OR, if used in the present invention, may generally be located in the same portion of the genome, such as between about 20 bp and about 20 kb upstream or downstream of (including embodiments being located within the same gene as) the genomic location of at least one of the (eg reference) DMRs used herein. Particularly in the context of foetal fraction of cfDNA, detection (and particularly quantification) of such species of DNA is enhanced (eg, in terms of sensitivity, accuracy and/or precision) if the OR is so located in the same portion of the genome as one of the reference DMRs. Without being bound by theory, it is believed that with such similarly-located DMR(s) and OR, particularly when used in such context, the effect of variation in chromatin/nucleosome packing across the genome—and hence stability/degradation of different regions of genomic DNA—is mitigated, such that any difference in stability/degradation of a (eg reference) DMR (eg detecting the reference chromosome species of foetal DNA) as compared to the OR (is detecting total DNA) is less, and hence a relative (and absolute) quantification may be made without it being (significantly) confounded by quantitative differences brought about by (significantly) differential chromatin/nucleosome packing across the genome between such a DMR and an OR.

Figure 1:
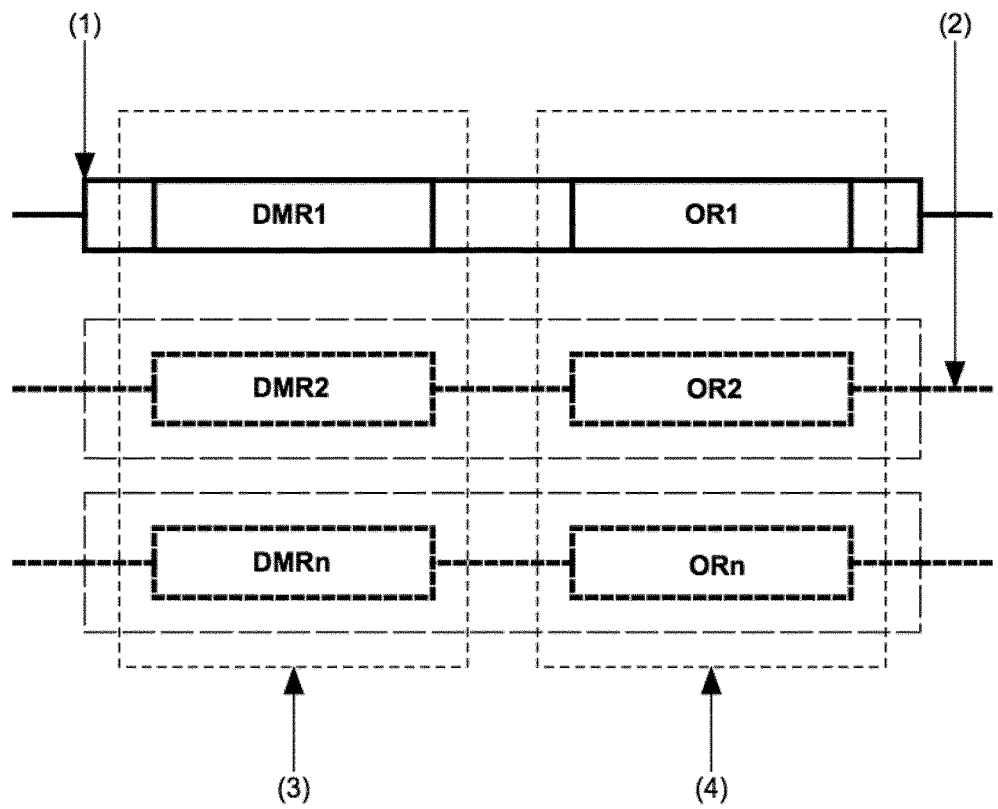
FIG. 1 depicts: (a) a schematic representation of the differentially methylated region(s) ("DMR") and other regions(s) ("OR") used in a first differential methylation-based DNA detection method; and (b) a schematic representation of the differentially methylated regions ("DMR") and other regions(s) ("OR") used in a second differential methylation-based DNA detection method.
Figure 1:
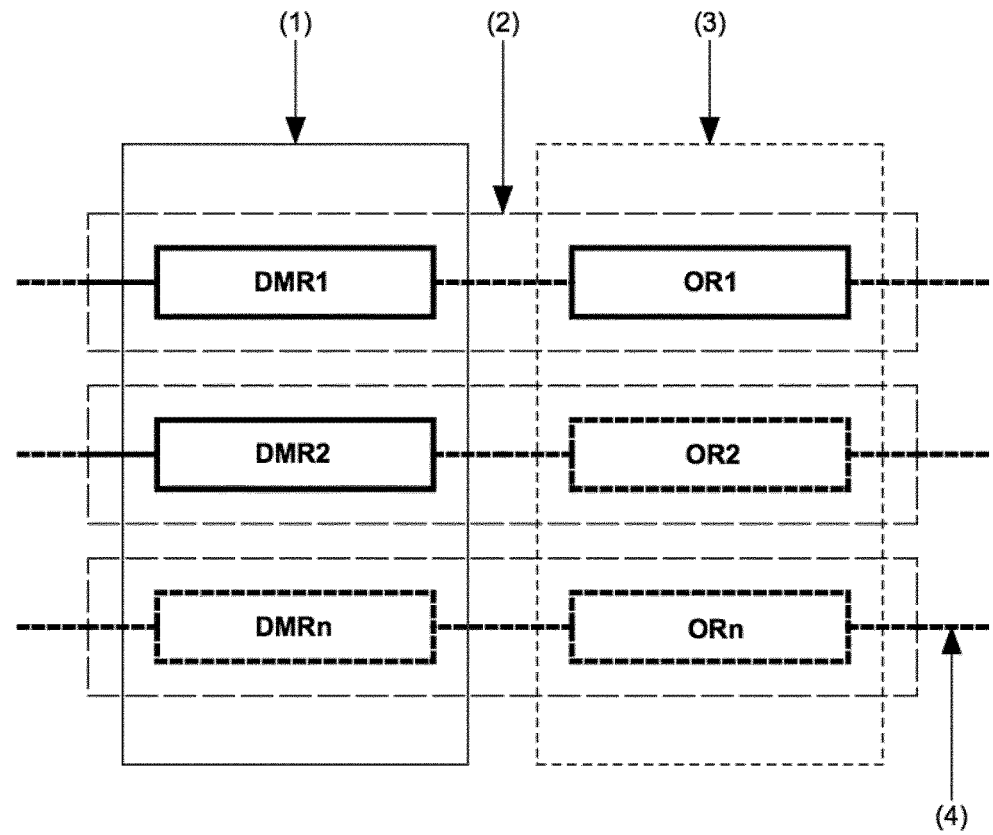

The present invention includes the optional use of one OR in optional step (f) to provide for the detection of an amount of total DNA in the admixture. However, the present invention also encompasses embodiments that use more than one OR. For example, the invention includes such embodiments wherein said detection in step (f) comprises using at least two of said ORs, such as two, three or four of said ORs. In particular embodiments of all aspects of the present invention, the number of said ORs used in optional step (f) is the same as the number of reference DMRs used in step (d). For example, if two reference DMRs are used then two other regions are used in such an embodiment, and if three reference DMRs are used then three other regions are used (such as depicted in FIG. 1).

As described elsewhere herein, the present invention includes embodiments where the optional OR is generally located in the same portion of the genome, such as between about 20 bp and about 20 kb upstream or downstream of (including embodiments within the same gene as) the genomic location of at least one of the DMRs (such as a reference DMR) used herein. Also as described elsewhere herein, certain embodiments of the present invention include where the OR is generally located in the same portion of the genome, such as between about 20 bp and about 20 kb upstream or downstream of (including embodiments within the same gene as) the genomic location of at least one of the DMRs used herein (such as a target DMR). In certain embodiments, the OR does not overlap with such a DMR. Accordingly, if multiple ORs are used in the present invention, then embodiments are included where two or more of such ORs are similarly located in the genome to the two or more DMRs (such as reference DMRs). For example, one of said ORs may be located between about 20 bp and about 20 kb upstream or downstream of (including embodiments within the same gene as) a reference DMR used in step (d) and each other of the said OR (eg, a second OR) is located between about 20 bp and about 20 kb upstream or downstream of (including embodiments within the same gene as) another of said (eg, non-overlapping) DMRs (eg, a second reference DMR). In certain embodiments an additional OR, may overlap with a DMR (such as a reference DMR).

An OR used in the present invention, when generally located in the same portion of the genome as a DMR (such as a reference DMR), may be located upstream or downstream of one of said DMRs within a distance selected from the group consisting of: between about 16 kb to 20 bp, 14 kb to 20 bp, 12 kb to 20 bp, 10 kb to 20 bp, 8 kb to 20 bp, 6 kb to 20 bp, 5 kb to 20 bp, 4 kb to 20 bp, 3 kb to 2 bp, 16 kb to 20 bp, 1 kb to 20 bp, 500 bp to 20 bp, 200 bp to 20 bp, 20 kb to 15 kb, 15 kb to 10 kb, 12 kb to 8 kb, 10 kb to 8 kb, 11 kb to 7 kb, 11 kb to 10 kb, 9 kb to 8 kb, 8 kb to 6 kb, 6 kb to 4 kb, 4 kb to 2 kb, 2 kb to 500 bp, 1 kb to 100 bp, 500 bp to 50 bp, 400 bp to 200 bp and 500 bp to 100 bp and 500 bp to 300 bp. In particular embodiments, each OR used in the present invention is so generally located to a different of the DMRs used (such as reference DMRs).

If multiple ORs are used, then the present invention includes embodiments where the detection in optional step (f) is made using the same detectable label for each of said ORs and/or comprises multiplex real-time quantitative PCR using at least two labelled probes each of which is specific for one of said ORs.

In certain embodiments of the present inventive method, the detection in step (f), if conducted, comprises using at least two of said ORs. In particular of such embodiments, the number of said ORs may be the same as the number of reference DMRs used in step (d). In a further of such embodiments, one of said reference DMRs and one of said ORs may be both located on one reference chromosome (eg human chromosome 5), and a second reference DMRs and a second of said ORs may be both located on another reference chromosome (eg human chromosome 12). In certain such further embodiments, one of said ORs is located between about 20 bp and about 20 kb upstream or downstream of a reference DMR used in step (d) and each other of the said ORs is located between about 20 bp and about 20 kb upstream or downstream of another of said reference DMRs.

In an embodiment of the present invention, the detection of the various DNA regions, ie the DMR(s) (and the OR(s), if included) may occur in a simplified process. Correspondingly, one feature of the present invention is that the detection of the various DNA regions, ie the DMRs (and the OR(s), if included), may occur in a simplified process. For example, using a single aliquot of DNA from the sample, such DNA regions may be detected in a single vessel. This feature may simplify the method(s), and can provide for more efficient and accurate detection (especially in those embodiments when detection is quantitative). The term "vessel" will be art recognised, and includes embodiments of a vessel (such as a tube, well of a microtiter plate, nano-well, capillary reaction vessel etc) in which a process or procedure comprised in the method occurs, such as a reaction and/or detection process or a step of a method of the present invention. Other such vessels may include droplets in oil/water emulsions, nanoparticles or a hybridisation chamber; as appropriate to the detection technology used. The detectable labels used, in certain embodiments of the present invention may be different for each of the target DMRs, and/or may be the same for each reference DMR and/or may be the same for each OR (if included), provided that, when detected essentially simultaneously, the label(s) used for the target DMRs is/are different (ie, can be separately detected) to the label(s) used for the reference DMR(s) (and for the ORs, if used). Alternatively, the detectable labels used, in certain embodiments of the present invention may be different (eg, not the same) for each DMR and/or may be different (eg, not the same) for each OR (if included). The detectable labels used in the method of the invention may be the same for each reference DMR and, in certain embodiments, may be the same for each OR (if included), provided that the label(s) used for the target DMRs is different, (ie, can be separately detected) to the label(s) used for the reference DMRs. And different to the label(s) used for the ORs (if used). Detectable labels that are "the same", can also include labels while structurally different, are functionally (essentially) similar as they cannot be significantly differentiated by the detection technology employed. For example, structurally different fluorescent dyes may be considered "the same" if their excitation and emission spectra are (substantially or essentially) similar, or overlap to such a degree that they are able to be excited and detected simultaneously with the same wavelength(s). Suitable labels (and detection modalities) are further described elsewhere herein. Preferably, the detection of the DMR(s) and OR(s) (if included) may be made effectively simultaneously. For example, within the same (reaction/detection) vessel, all such regions (and hence said species of DNA and total DNA) can be detected within less than about 5s, 1s, 0.5s, 100 ms, 10 ms, 1 ms, 100 us, 10 us or 1 us of each other (in particular, less than about 0.5s, and more particularly less than about 100 ms or each other), and for example without transferring the vessel, or the reaction/mixture, to any subsequent vessel, assay or equipment, or for example, without adapting or recalibrating the detection process for (any/either of) the DMR(s) or the OR(s) separately. The use of detectable label(s)—for example at least one for said first target DMR(s) and at least one for the reference DMR(s)—utilises components, process and/or steps that are non-natural. For example, a composition of two specific labels together with the specific DNA regions would (generally) not be found in nature. In particular, short probes used in quantitative probe-based PCR, while may comprise a DNA sequence that is a fragment of that found in a natural genome, when linked to a one or more labels (such as a fluorescent dye) form a specific labelled fragment that is non-natural.

By way of graphical description, a schematic representation of the general arrangement of the first target DMR(s), the reference DMRs the OR(s), if used, and the detectable label(s), as used for one embodiment of the present invention, is presented in FIG. 6. (1a) The presence of methylation in DNA at one first target DMR (DMR1) located on the chromosome relevant to the chromosomal aneuploidy is detected using a detectable label(s); (1b) The presence of methylation in DNA at a second first target DMR (DMR2) located on the same chromosome relevant to the chromosomal aneuploidy is detected using a different detectable label(s); (1') The presence of methylation in DNA at two reference DMRs is detected with the same detectable label(s) (but different to those used to detect the first target DMRs); (3') The detection of the reference DMRs may be detected in the context of two optional other regions ("OR1" and "OR2")) using the same detectable label(s) (but different to those used to detect the DMRs); (2) One or more of such ORs may be located in the same chromosome as a reference DMR; in particular (4) an OR may be in the same portion of the genome (eg, between about 20 bp and about 20 kb upstream or downstream of) a reference DMR.

In the context of the present invention, methylation at any particular DMR used in the inventive method (such as first target DMR or a reference DMR) may be detected in the context of at least one OR. By way of graphical description, a schematic representation of one possible general arrangement of such DMR(s), the OR(s) and the detectable label(s), as used for one embodiment of such DMR detection, is presented in FIG. 1(a). (1) The presence of methylation in DNA at DMR1 is detected in the context of an other region ("OR1") located within the same portion of the genome (eg, between about 20 bp and about 20 kb upstream or downstream of) DMR1. (2) Optionally, additional DMRs and/or ORs (such as DMR2 and/or OR2, and up to DMRn and ORn) may be detected, and pairs of such additional DMRs and ORs may each be co-located in the same portion of the genome (eg, between about 20 bp and about 20 kb upstream or downstream of) as each other. Optionally, (3) the presence of methylation in DNA is detected at multiple DMRs—when located on the same target chromosome or located on one or more reference chromosomes—using the same detectable label(s) and/or (4) the amount of total DNA detected using at least one OR (OR1, and optionally, OR2 or up to ORn is detected using different detectable label(s) to those used to detect methylation at the DMR(s) (optionally, the detectable label(s) used is the same for all the ORs—when located on the same target chromosome or located on one or more reference chromosomes—).

Also in the context of the present invention, when methylation at two or more DMRs used (such as first target DMR or a reference DMR)—when located on the same target chromosome or located on one or more reference chromosomes—may be detected in using the same detectable label(s). By way of graphical description, a schematic representation of the general arrangement of such DMRs, the OR(s) (if used) and the detectable label(s), as used for one embodiment of such DMR detection, is presented in FIG. 1(b). (1) The presence of methylation in DNA at two or more DMRs, DMR1 and DMR2 (and, optionally, up to DMRn)—when located on the same target chromosome or located on one or more reference chromosomes, is in each case detected using the same detectable label(s). (2) Optionally, an other region ("OR") may be located within the same portion of the genome (eg, between about 20 bp and about 20 kb upstream or downstream of) one of the DMRs). (3) The amount of total DNA detected using at least one OR (OR1, and optionally, OR2 or up to ORn) is detected using different detectable label(s) to those used to detect methylation at the DMRs (optionally, the detectable label(s) used is the same for all the ORs—when located on the same target chromosome or located on one or more reference chromosomes). (4) Optionally, methylation at more than two DMRs is so detected, and/or the amount of total DNA is detected at more than one OR.

The use of such a combination of features in the present invention provides opportunity for efficiency improvements and/or synergistic enchantment of outcome. For example, an improved sensitivity and/or accuracy and/or specificity and/or precision of detection (eg, detection of a quantitative amount) or said species of (foetal) DNA, in particular of the reference chromosome, can be obtained by the use of such a combination; the degree of improvement of which can be synergistic, as compared to the use of each feature alone; eg the enhancement obtained by use of the combined features being greater than the sum of each enhancement obtained by the use of each feature individually. In certain embodiments of the invention, the assay or test provides an overall sensitivity (true positive rate), specificity (true negative rate) and/or non-reportable rate as desired for such test; for example: a sensitivity of 100%, almost 100%, greater than 97% (in particular, greater than 97.5%) or greater than 95%; a specificity of greater than 95%, in particular greater than 96%; and/or a non-reportable rate of less than 10% (in particular, less than 7%), such as less than 6% or 5%. In particular embodiments, the assay or test of the invention can provide a sensitivity of greater than 95%, a specificity of greater than 90% and a non-reportable rate of less than 10%, and more particularly it may provide a sensitivity of greater than 97%, a specificity of greater than 95% and a non-reportable rate of less than 7%.

As will now be apparent to the person of ordinary skill following the disclosure of the present invention, an analogous and additional step to step (c) may be conducted in the method so as to detect methylation—and hence determine/quantitate/compare—the amount of a second target chromosome (eg relative to the reference chromosome(s)) where such second target chromosome is also a (eg different) chromosome relevant to a (eg different) chromosomal aneuploidy. Such a method that is able to detect the presence of two (or more) different chromosomal aneuploidies in a foetus carried by a pregnant female has particular advantages in terms of cost, speed and convenience.

Accordingly, in certain embodiments of the present invention, then method further comprises the steps of:

(c)' determining an amount of a second target species of DNA, being a chromosome relevant to a different chromosomal aneuploidy, in said sample by detecting in said sample the presence of methylation at two or more second target DMRs located on the chromosome relevant to said different chromosomal aneuploidy, said second target DMRs differently methylated between DNA that originates from cells of a foetus and/or the placenta of a foetus and DNA of maternal origin, the modification of DNA of the second target DMRs by said reagent is sensitive to methylation of DNA, wherein a detected amount of methylated DNA at one or more of said second target DMRs indicates said amount of second target species of DNA in said sample; and (e)' determining relative amount(s), preferable ratio(s), of an amount determined from step (c)' and an amount determined from step (d), wherein one or more of said relative amount(s) indicates the presence or absence of the different chromosomal aneuploidy in the foetus, preferably wherein, said detections in step (c) and step (c)' and step (d) and optional step (f) are made using the same aliquot of DNA of said sample, and in the same vessel, and effectively simultaneously for said first target DMRs and said second target DMRs and said reference DMRs, and, optionally, using: (x) the same detectable labels(s) for at least two (preferably each) of said reference DMRs; and/or (y) a different detectable label(s) for at least two (preferably each) of said first target DMRs and for at least two (preferably each) of said second target DMRs and for the optional OR(s).

In the context of the second target DMRs, the various possible arrangements of detectable label(s) used for such second target DMRs may be as described for the first target DMRs, provide however that in certain embodiments a different detectable label(s) is/are used for such second target DMRs that is/are used for such first target DMRs and as is used for the reference DMRs and, if OR(s) are used in the method, as is/are used for such OR(s).

In the context of such embodiment of the present invention when the method is practiced to seek to detect two or more chromosomal aneuploidies in a foetus carried by a pregnant human female, the chromosome relevant to the different chromosomal aneuploidy may be a human chromosome selected from the list consisting of: chromosome 21, chromosome 18, chromosome 13, X-chromosome and Y-chromosome, in particular where such chromosome is different to the first target chromosome. For example, the chromosome relevant to the different chromosomal aneuploidy may be human chromosome 18 or chromosome 13, in particular human chromosome 18: wherein said different chromosomal aneuploidy is an aneuploidy of said different chromosome, such as a trisomy of said different chromosome.

In particular of such embodiments when the method is practiced to seek to detect two or more chromosomal aneuploidies in a foetus carried by a pregnant human female, said chromosome relevant to the chromosomal aneuploidy and said different chromosome relevant to the different chromosomal aneuploidy may be the pairs of human chromosomes selected from the list consisting of: human chromosomes 21 and 18, human chromosomes 21 and 13, human chromosomes 18 and 13; wherein said chromosomal aneuploidy and said different chromosomal aneuploidy is an aneuploidy of the respective chromosome, preferably a trisomy of the respective chromosome.

In more particular of such embodiments when the method is practiced to seek to detect two or more chromosomal aneuploidies in a foetus carried by a pregnant human female, each of said first target DMRs may be located on human chromosome 21, on human chromosome 18 or on human chromosome 13, preferably on human chromosome 21; and optionally, if present each of said second target DMRs may be located on human chromosome 18 or on human chromosome 13.

The present invention also encompasses where further analogous additional steps to step (c) (and step (e)) are practiced; each further analogous additional step using further target DMRs to indicate if a different chromosome aneuploidy (such as two, three, four or more than four chromosome aneuploidies) is present in the foetus. For example, one step (c) (and step (e)) may be configured to detect an aneuploidy at human chromosome 21, a first additional step (c) (and step (e)) may be configured to detect an aneuploidy at human chromosome 18 and a second additional step (c) (and step (e)) may be configured to detect an aneuploidy at human chromosome 13.

Any possible embodiment described herein as being applicable to a step (c) (or a step (e)), may equally be applicable to any of such analogous additional step (c) (or a step (e)), such as to step (c)' (or step (e)'). For example, in particular of such embodiments of the present invention with a step (e)', the method may further include wherein in step (e)' said relative amount(s) or ratio(s) are compared with threshold(s) and/or reference distribution(s), wherein one or more of said relative amount(s) or ratio(s) higher or lower than said threshold(s) and/or reference distribution(s) indicates the presence of the different chromosomal aneuploidy in the foetus.

In certain embodiments, prior to or as part of the detection that occurs as part of a step (c) and/or a step (d) and/or optional step (c)' and/or optional step (f) of any method of present invention, each DNA region comprising said DMR(s) and/or said optional OR(s), respectively, is(are) amplified. Amplification of DNA may be conducted using any suitable replication process, and in particular of such embodiments, each of the DMR(s) and/or optional OR(s), is amplified by a polymerase chain reaction (PCR) using primers suitably designed for each DMR and/or OR. The person of ordinary skill will readily be able to design such PCR primers for use in the method of the invention, for example by use of primer design algorithms and programs such as Clone Manager Professional 9 (Sci-Ed Software), Vector NTI (Life Technologies), or web-based tools such as those found from www.ncbi.nlm.nih.gov/tools/primer-blast/ or molbiol-tools.ca/PCR.htm. Those embodiments of the present invention that comprise PCR amplification can further comprises specific steps that are related to the practice of PCR, such as any of those described herein, or in particular the steps of: (A) providing a reaction mixture comprising a double-stranded target DNA, a pair of primers (for example, a pair of primers disclosed herein) designed to amplify a region of such DNA (such as a DMR or an optional OR as described herein) wherein the first primer is complementary to a sequence on the first strand of the target DNA and the second primer is complementary to a sequence on the second strand of the target DNA, Taq polymerase, and a plurality of free nucleotides comprising adenine, thymine, cytosine and guanine; (B) heating the reaction mixture to a first predetermined temperature for a first predetermined time to separate the strands of the target DNA from each other; (C) cooling the reaction mixture to a second predetermined temperature for a second predetermined time under conditions to allow the first and second primers to hybridise with their complementary sequences on the first and second strands of the target DNA, and to allow the Taq polymerase to extend the primers; and (D) repeating steps (B) and (C) at least 20 times.

The term "probe-based" quantitative PCR is art recognised, and encompasses various embodiments described and marketed under different brand names (such as "TaqMan" PCR of Roche), and uses a (eg fluorescent) reporter probe that is specific for the detection of a given amplicon (eg a DMR or another region). Probe-based quantitative PCR is distinct from quantitative PCR using double-stranded DNA-binding dyes (eg SYBR Green) as reporters, as such double-stranded DNA-binding dyes bind non-specially to any double-stranded amplicon and eg cannot be used to distinguish between detection of the DMR(s) (ie said species of DNA) from detection of the other region(s) (ie detection of total DNA). As the person of ordinary skill will appreciate, a specific amplicon of PCR may be detected using a single probe or by using multiple probes (such as two or three probes) for an amplicon. In particular, probe-based quantitative PCR can include amplification reactions into which have been incorporated processes of detecting a target nucleic acid using labelled oligonucleotides that use the 5' to 3' nuclease activity of a nucleic acid polymerase to cleave annealed labelled oligonucleotide (eg the probe) from hybridised duplexes and release labelled oligonucleotide fragments for detection. Such approaches and processes are known in the art and are described in more general terms by Gelfand et al (U.S. Pat. No. 5,804,375, EP0543942 and related family members) and/or Livak et al (U.S. Pat. No. 6,258,569, EP0792374 and related family members), and include where the probe comprises a detectable label in combination with a quencher molecule that quenches the detectability of the label when bound, such that 5' to 3' nuclease (and hence amplification) is required to occur before the detectable label is released into the reaction mixture (way from the quencher) and hence may be detected. Furthermore, "probe-based" quantitative PCR approaches may by alternatively or additionally enhanced by the use of probes that comprise an oligonucleotide-fluorophore-quencher-minor groove binder conjugates, such as described by Reed et al (U.S. Pat. No. 6,727,356, EP1235938 and related family members). Exemplary quencher molecules include BHQ1, BHQ3, Eclipse, BHQ2, BBQ650.

Such probe-based quantitative PCR may be conducted in an analogue-approach, using a machine such as a LightCycler in which the intensity of signal (eg over time) is measured and used to quantitatively determine detection. Systems and approaches for such detection are described by Woudenberg et al (U56929907, EP0706649 and related family members) and/or Higuchi (U55994056, EP0512334 and related family members). Alternatively, digital PCR (dPCR), ie, PCR conducted in multiple events so as to determine the number of amplification events as method to quantitate an amount of detected DNA. For example, dPCR that is conducted in nano-wells or droplets (ddPCR). Commercially available suppliers of ddPCR technology include Bio-Rad and Rain Dance.

The person of ordinary skill will be able to design suitable primers and probes (and with suitable labels, eg dyes) for probe-based quantitative PCR detection of the DMRs and/or OR(s); for example by using primer/probe design software as described elsewhere herein. As will be known, the PCR primers may overlap methylation site(s) specific for the methylation-specific modifying reagent used in the methods, in particular when the reagent comprises one or more methylation sensitive restriction enzyme, such as one (or a combination thereof) as disclosed herein. In particular such embodiments, one or other (or when considered together, both) of the PCR primers for a given DMR may overlap two or three such methylation sites (such as two or three restriction sites for methylation-sensitive restriction enzymes, each of which may comprise, or comprises, a methylation site). Alternatively or in addition, the primers for a DMR may be designed to flank one, two, three or more such methylation sites, such as up to 10, 15, 20, 25 or 50 such methylation sites, in particular flanking restriction sites for one, two, three or more such methylation sites (more particularly, between two and four such methylation sites), such as up to 10, 15, 20, 25 or 50 methylation-sensitive restriction enzymes, each of which may comprise, or comprises, a methylation site.

In other embodiments, a detectable label used in step (c) and/or a step (d) and/or optional step (c)' and/or optional step (f) of a method of the invention is independently selected from the group consisting of: fluorescent, protein, small molecule or radioactive label. For example, fluorescent labels that are the same (including, by having similar or overlapping excitation and/or emission spectra) may be used for the DMR(s), and a fluorescent label that has an excitation and/or emission spectra (in particular, a different emission spectrum) may be used for detection of the optional OR(s). The person of ordinary skill will be able to select appropriate such fluorescent label(s) for use in the present invention from, for example, the group consisting of: FAM, TET, JOE, VIC, HEX, NED, PET, ROX, TAMRA, Quasar and Texas Red and LCCyan500, 6FAM, Cy5, and LCRed610, and LCRed640. Fluorescent labels can be used with a corresponding quencher moiety; the selection of such label-quencher pairs being well known in the art, and can include a label-quencher pair selected from the list consisting of: LCCyan500/BHQ1, Cy5/BHQ3, 6FAM/Eclipse, LCRed610/BBQ650 and LCRed640/BHQ3.

In other embodiments, a detectable label may be a protein or small molecule tag that, for example, can be detected using a specific antibody and ELISA-type detection approaches. The use of the same protein or small molecule or a detectably different protein or small molecule as applicable for the same or different labels and appropriate detection of the various DMRs and/or optional OR(s), may also be utilised for the detectable label(s) used in the present invention. Different radioactive labels may be distinguished by their emission energy, penetration/excitation characteristics and particle-type (for example, by distinguishing between alpha and beta particles). Other detectable labels (such as nucleic-acid coded tag) may also be employed in the present invention.

In particular embodiments of the present invention, the detection in step (c) and/or step (c)' of a method of the example comprises real-time quantitative probe-based PCR, eg by using at least one labelled probe which is specific for one of the first target DMR(s) and/or optional second target DMR(s). In those embodiments where PCR amplification of multiple DMRs and/or optional OR(s) is made in the same reaction, such PCR can be considered as "multiplex" (or "duplex" if only two DMRs and/or OR(s) are so amplified). Likewise, the detection in step (d) in the methods of the invention may, in addition or alternatively, comprise real-time quantitative probe-based PCR, such as by using at least one labelled probe specific for one of said reference DMR(s). Also likewise, the detection in optional step (f) in the methods of the invention may, in addition or alternatively, comprise real-time quantitative probe-based PCR, such as by using at least one labelled probe specific for one of said OR(s).

The primers and/or probes used in the method of the present invention may be configured or designed to detect methylation at one or more of the DMRs my sequence specific detection following eg bisulphite conversion of methylated CpGs to uracil. By way of non-limiting example, such detection may occur MSP or MethylLight as described elsewhere herein.

In particular embodiments of the present invention, the detection in step (c) of a method of the invention comprises real-time quantitative probe-based PCR, eg by using at least two labelled probes, each of which is specific for one of said two or more first target DMRs; and/or said detection in step (d) comprises multiplex real-time probe-based quantitative probe-based PCR using at least two labelled probes each of which specific for one of said reference DMRs.

In other embodiments of the present invention, said detection in step (f) comprises real-time quantitative PCR using at least one labelled probe specific for one of said OR(s).

When two of more of said OR(s) are used, the present invention includes embodiments where detection in optional step (f) is made using: (x) the same detectable label(s) for each of said ORs; and/or wherein said detection in step (f)

comprises multiplex real-time quantitative probe-based PCR using at least two labelled probes each of which is specific for one of said ORs.

In particular embodiments, one or more (preferably all) detection steps (ie, those required for DMR(s) and OR(s)) are conducted in an efficient and effective manner using multiplex quantitative probe-based (eg TaqMan) PCR, in one process step or reaction. For example, in particular embodiments of the present invention, said detection step (c) and step (d), and optional step (c)' and optional step (f), are made using the same aliquot of DNA of said sample, and in the same reaction/detection vessel, and effectively simultaneously with each other, and by multiplex real-time quantitative probe-based PCR using at least one labelled probe specific for each of the said DMRs and optional OR(s). In particular of such embodiments, the reagent comprises one or more methylation sensitive restriction enzyme, such as one (or a combination thereof) as disclosed herein.

The present invention may also include further procedures, such as one or more control procedures. For example, the present invention can include one or more steps directed to the detection of a third class of DNA region that acts as a control for the modification step (eg, as a control for restriction enzyme digestion). Such embodiments may, for example, also be conducted using multiplex real-time quantitative probe-based PCR wherein such control region is amplified and detected by a further set of primer/probe(s) with a further detectable label used for such class of region.

In the present invention, said target and reference species of DNA originate from cells of a foetus and/or the placenta of a foetus and said sample is from a pregnant female. In certain embodiments, the sample may be obtained in a non-invasive manner. For example, said species of DNA is circulating cell-free DNA that has been detected from the sample being blood or a blood fraction (such as plasma or serum) that has been obtained from the pregnant female by conventional means such as a blood collection tube. In such embodiments, the sample can comprise DNA that has a maternal origin; that is it originates from cells (and hence the genome of) the pregnant female.

In all aspects of the present invention, there exist embodiments wherein the sample is a tissue sample or a sample of biological fluid. In particular, the sample is whole blood or a blood fraction (eg, such as plasma or serum). In alternative embodiments, the sample is biological fluid selected from the group consisting of: urine, saliva, sweat, tears, phlegm, beast milk, breast aspirate. vaginal secretion, vaginal wash and colonic wash. In more particular embodiments, the sample is a plasma or serum sample from the pregnant female, or is urine from the pregnant female. In other embodiments, the sample is largely (or essentially) free from cells, and/or is not a whole blood sample.

In particular embodiments of all aspects of the invention, said species of DNA that originate from cells of a foetus and/or the placenta of a foetus is circulating cell-free DNA and said sample is a blood fraction such as plasma or serum.

The present invention includes embodiments where the DMR(s) (such as the first or second target DMRs and/or the reference DMRs) is(are) hypermethylated in foetal DNA and hypo methylated in maternal DNA. In certain embodiments, such a DMR may be located in a promoter, enhancer region or an exon of a gene, such as a gene disclosed herein, or a DNA sequence of no more than 10 kbp, 5 kbp, 1 kbp, 500 bp, 250 bp, 150 bp, 100 bp or 50 bp upstream and/or downstream from such region and/or gene. Alternatively, a DMR may be located in an intron of such a gene, or in a non-coding region of the genome. In particular embodiments of all aspects of the present invention, such genome and/or gene is a human genome or gene.

Specifically included in the present invention are embodiments wherein said DMR(s) comprises at least one, preferably at least two, methylation site(s) specific for said reagent. For example, comprising three, four, five, six, seven, eight, nine, ten or more than then, such as about 15, 20, 25, 50 or more than 50 methylation site(s) specific for said reagent.

In the context of the DMRs located on the chromosome relevant to the chromosomal aneuploidy, the present invention encompasses any suitable DMR located on such a chromosome, such as those described anywhere herein.

In particular embodiments of the present invention, for example when the method is configured to seek the detection of a chromosomal aneuploidy of human chromosome 21, said first target DMRs, and/or said optional second target DMRs, are each located in a region and/or gene independently selected from one disclosed in WO 2011/092592, including on selected from the list consisting of: EP1, EP2, EP3, EP4, EP5, EP6, EP7, EP8, EP9, EP10, EP11 and EP12 of WO 2011/092592 (SEQ ID NOs: 33-44 of WO 2011/092592), as further investigated in Lim et al 2014, BMC Medical Genomics 7:1).

In other particular embodiments of the present invention, said first target DMRs, and/or said optional second target DMRs, are each located in a region and/or gene independently selected from the list consisting of: AIRE (ENSG00000160224; human Autoimmune regulator gene; Chr21:44,285,838-44,298,648 forward strand, GRCh38: CM000683.2), SIM2 (ENSG00000159263; human Single-minded homolog 2; Chr21:36,699,133-36,749,917 forward strand, GRCh38:CM000683.2) and ERG (ENSG00000157554; human ETS-related gene; Chr21:38, 380,027-38,661,780 reverse strand, GRCh38:CM000683.2), or a DNA sequence of no more than 10 kbp, 5 kbp, 1 kbp, 500 bp, 250 bp, 150 bp, 100 bp or 50 bp upstream and/or downstream from such region and/or gene.

In other particular embodiments of the present invention, said first target DMRs, and/or said optional second target DMRs, are each located in a region and/or gene independently selected from the list consisting of: PDE9A (ENSG00000160191; human phosphodiesterase 9A; Chr21: 42,653,636-42,775,509 forward strand, GRCh38: CM000683.2), PPP1R2P2 (ENSG00000234008; human protein phosphatase 1, regulatory (inhibitor) subunit pseudogene 2 gene; Chr21:35,887,195-35,887,807 forward strand, GRCh38:CM000683.2), CBR1 (ENSG00000159228; human carbonyl reductase 1 gene; Chr 21:36,069,941-36, 073,166 forward strand, GRCh38:CM000683.2), DSCAM (ENSG00000171587; human Down syndrome cell adhesion molecule gene; Chromosome 21: 40,010,999-40,847,139 reverse strand, GRCh38:CM000683.2), C21orf29 (ENSG00000175894; human thrombospondin-type laminin G domain and EAR repeats gene; Chromosome 21: 44,497, 892-44,711,580 reverse strand, GRCh38:CM000683.2), HLCS (ENSG00000159267; human holocarboxylase synthetase gene; Chromosome 21: 36,750,888-36,990,236 reverse strand, GRCh38:CM000683.2), or a DNA sequence of no more than 10 kbp, 5 kbp, 1 kbp, 500 bp, 250 bp, 150 bp, 100 bp or 50 bp upstream and/or downstream from such region and/or gene, in particular each case a region disclosed in WO 2007/132176; or selected from the list consisting of: CGI37, Similarity to Fem1A (*C. elegans*), CGI009 and CGI132, or a DNA sequence of no more than 10 kbp, 5 kbp, 1 kbp, 500 bp, 250 bp, 150 bp, 100 bp or 50 bp upstream and/or downstream from such region and/or gene, in particular each case a region disclosed in WO 2007/132176. Or, said first target DMRs, and/or said optional second target DMRs, are each located in a region and/or gene being C21orf57 (ENSG00000182362; ybeY metallopeptidase; Chromosome 21: 46,286,337-46,297,751 forward strand, GRCh38:CM000683.2), or a DNA sequence of no more than 10 kbp, 5 kbp, 1 kbp, 500 bp, 250 bp, 150 bp, 100 bp or 50 bp upstream and/or downstream from such region and/or gene. Or, said first target DMRs, and/or said optional second target DMRs, are each located in a region and/or gene being C21orf29 (ENSG00000175894; Chromosome 21: 44,497,892-44,711,580 reverse strand, GRCh38:CM000683.2), or a DNA sequence of no more than 10 kbp, 5 kbp, 1 kbp, 500 bp, 250 bp, 150 bp, 100 bp or 50 bp upstream and/or downstream from such region and/or gene. Or, said first target DMRs, and/or said optional second target DMRs, are each located in a region and/or gene being CGI149 (ENSG00000115561; charged multivesicular body protein 3, CHMP3; HGNC:29865; Chromosome 2: 86,503,431-86,563,479 reverse strand, GRCh38:CM000664.2), or a DNA sequence of no more than 10 kbp, 5 kbp, 1 kbp, 500 bp, 250 bp, 150 bp, 100 bp or 50 bp upstream and/or downstream from such region and/or gene (Chim at al 2008; Yin et al, 2014; Prenat Diagn 34:63). In particular of such embodiments, at least one of said first target DMRs (or at least one optional second target DMR) is located in in DSCAM or C21orf57 or C21orf29 or CGI149, or a DNA sequence of no more than 10 kbp, 5 kbp, 1 kbp, 500 bp, 250 bp, 150 bp, 100 bp or 50 bp upstream and/or downstream from such region and/or gene; such as where one of said first (or optional second) target DMRs is located in DSCAM and another of said first (or optional second) target DMRs is located in C21orf57 (or in C21orf29 or CGI149), or a DNA sequence of no more than 10 kbp, 5 kbp, 1 kbp, 500 bp, 250 bp, 150 bp, 100 bp or 50 bp upstream and/or downstream from such region and/or gene.

In other particular embodiments of the present invention, said first target DMRs, and/or said optional second target DMRs, are each located in a region and/or gene independently selected from the list consisting of: SEQ ID No NOs 33, 34, 35, 36, 37, 38, 39, 176, 179, 180, 184, 188, 189, 190, 191, 193, 195, 198, 199, 200, 201, 202, 203, 205, 206, 207, 208, 209, 210, 211, 212, 213, 214, 221, 223, 225, 226, 231, 232, 233, 235, 239, 241, 257, 258, 259, and 261 of WO 2011/034631, such as independently selected from the list consisting of: SEQ ID No NOs 37, 257, 258 and 259, in particular any such region and/or gene disclosed in WO 2011/034631 as being hypermethylated in foetal DNA relative to maternal DNA. In certain of such particular embodiments of the present invention, one or said first target DMRs is located in a region and/or gene being SEQ ID NO 37 of WO 2011/034631 (SEQ ID NO.: 51 of the present application) and another of said first target DMRs is located in a region and/or gene being SEQ ID NO.: 258 of WO 2011/034631 (SEQ ID NO.: 185 of the present application), or another of said first target DMRs is located in a region and/or gene being SEQ ID NO.: 239 of WO 2011/034631 (SEQ ID NO.: 182 of the present application), or another of said first target DMRs is located in a region and/or gene being SEQ ID NO.: 39 of WO 2011/034631 (SEQ ID NO.: 125 of the present application), or located within about 100 bp, 50 bp, 40 bp, 30 bp, 20 bp or 10 bp upstream and/or downstream from such region and/or gene.

In alternative embodiments of the present invention, for example when the method is configured to seek the detection of a chromosomal aneuploidy of human chromosome 18, said first target DMRs, and/or said optional second target DMRs, are each located in a region and/or gene independently selected from: VAPA-APCDDI (ENSG00000101558; VAMP (vesicle-associated membrane protein)-associated protein A; Chromosome 18: 9,914,002-9,960,021 forward strand, GRCh38:CM000680.2) and maspin (ENSG00000206075; also known as SERPINB5; serpin peptidase inhibitor, clade B (ovalbumin), member 5; Chromosome 18: 63,476,761-63,505,085 forward strand, GRCh38:CM000680.2), or a DNA sequence of no more than 10 kbp, 5 kbp, 1 kbp, 500 bp, 250 bp, 150 bp, 100 bp or 50 bp upstream and/or downstream from such region and/or gene. In particular such embodiments, said first target DMRs, and/or said optional second target DMRs, are each located in a region of the maspin (aka "SERPINB5") gene that described in EP 1 751 307 as being differentially methylated between a foetus and its mother, or a DNA sequence of no more than 10 kbp, 5 kbp, 1 kbp, 500 bp, 250 bp, 150 bp, 100 bp or 50 bp upstream and/or downstream from such region and/or gene. Or, said first target DMRs, and/or said optional second target DMRs, are each located in a region and/or gene being nuclear factor of activated T-cells, cytoplasmic 1 (NFATC1; ENSG00000131196; Chromosome 18: 79,395,856-79,529,325 forward strand, GRCh38:CM000680.2), or a DNA sequence of no more than 10 kbp, 5 kbp, 1 kbp, 500 bp, 250 bp, 150 bp, 100 bp or 50 bp upstream and/or downstream from such region and/or gene. Or, said first target DMRs, and/or said optional second target DMRs, are each located in a region and/or gene being chr18gr00094 of WO 2011/034631, or a DNA sequence of no more than 10 kbp, 5 kbp, 1 kbp, 500 bp, 250 bp, 150 bp, 100 bp or 50 bp upstream and/or downstream from such region and/or gene.

In other alternative embodiments of the present invention, said first target DMRs, and/or said optional second target DMRs, are each located in a region and/or gene independently selected from the list consisting of: SEQ ID No NOs 21, 22, 23, 24, 25, 26, 27, 28, 29, 30, 31 and 32 of WO 2011/034631 (eg SEQ ID No NO:31 of WO 2011/034631/ SEQ ID No NO:17 of this application, or SEQ ID NO:23 of WO 2011/034631/SEQ ID No NO:9 of this application), in particular any such region and/or gene disclosed in WO 2011/034631 as being hypermethylated in foetal DNA relative to maternal DNA, or located within about 100 bp, 50 bp, 40 bp, 30 bp, 20 bp, 10 bp or 5 bp upstream and/or downstream from such region and/or gene, in particular, located less than 20 bp upstream and/or downstream from such region and/or gene and more particularly less than 10 bp upstream and/or downstream from such region and/or gene.

In further embodiments of the present invention, for example when the method is configured to seek the detection of a chromosomal aneuploidy of human chromosome 13, said first target DMRs, and/or said optional second target DMRs, are each located in a region and/or gene independently selected from: the list consisting of: SEQ ID No NOs 1, 2, 3, 4, 5, 6, 7, 8, 9, 10, 11, 12, 13, 14, 15, 16, 17, 18, 19 and 20 of WO 2011/034631, in particular any such region and/or gene disclosed in WO 2011/034631 as being hypermethylated in foetal DNA relative to maternal DNA.

In the context of the DMRs located on the reference chromosome, the present invention encompasses any suitable DMR located on such a chromosome, such as those described anywhere herein.

In particular embodiments of the present invention, for example when the method is configured to seek the detection of a reference chromosome, at least one of said reference DMRs is (preferably two of more of said reference DMRs each) located in a region and/or gene independently selected from the list consisting of: RASSF1A (ENSG00000068028; Ras association (RalGDS/AF-6) domain family member 1; Chromosome 3: 50,329,782-50,340,980 reverse strand, GRCh38:CM000665.2), TBX3 (ENSG00000135111; T-box 3; Chromosome 12: 114,670,254-114,684,164 reverse strand, GRCh38:CM000674.2), CDC42EP1 (ENSG00000128283; CDC42 effector protein (Rho GTPase binding) 1; Chromosome 22: 37,560,447-37,569,405 forward strand, GRCh38:CM000684.2), PCDHGA1 (ENSG00000204956; protocadherin gamma subfamily A, 1; Chromosome 5: 141,330,571-141,512,981 forward strand, GRCh38:CM000667.2), and SPN (ENSG00000197471; sialophorin; Chromosome 16: 29,662,979-29,670,876 forward strand, GRCh38:CM000678.2); or selected from SOX14 (ENSG00000168875; SRY (sex determining region Y)-box 14; Chromosome 3: 137,764,284-137,766,338 forward strand, GRCh38:CM000665.2) and ZFY (ENSG00000067646; zinc finger protein, Y-linked; Chromosome Y: 2,935,281-2,982,506 forward strand, GRCh38:CM000686.2), or a DNA sequence of no more than 10 kbp, 5 kbp, 1 kbp, 500 bp, 250 bp, 150 bp, 100 bp or 50 bp upstream and/or downstream from such region and/or gene. Or located in MGC15523 (ENSG00000157637; also known as "SLC38A10", solute carrier family A 10; Chromosome 17: 81,245,000-81,295,547 reverse strand, GRCh38:CM000679.2) or a DNA sequence of no more than 10 kbp, 5 kbp, 1 kbp, 500 bp, 250 bp, 150 bp, 100 bp or 50 bp upstream and/or downstream from such region and/or gene. In particular of such embodiments, at least one of said reference DMRs is located in TBX3 or PCDHGA1 or a DNA sequence of no more than 10 kbp, 5 kbp, 1 kbp, 500 bp, 250 bp, 150 bp, 100 bp or 50 bp upstream and/or downstream from such region and/or gene; such as where one of said reference DMRs is located in TBX3 and another of said reference DMRs is located in PCDHGA1 or a DNA sequence of no more than 10 kbp, 5 kbp, 1 kbp, 500 bp, 250 bp, 150 bp, 100 bp or 50 bp upstream and/or downstream from such region and/or gene.

In other particular embodiments of the present invention, said reference DMRs are each located in a region and/or gene independently selected from the list consisting of: SEQ ID NOs: 40, 41, 42, 43, 44, 45, 46, 47, 48, 49, 50, 51, 52, 53, 54, 55, 56, 57, 58, 59 and 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162 and 163 of WO 2011/034631, such as independently selected from the list consisting of: SEQ ID No NOs 52, 118 and 142 of WO 2011/034631, in particular any such region and/or gene disclosed in WO 2011/034631 as being hypermethylated in foetal DNA relative to maternal DNA. In certain of such particular embodiments of the present invention, one or said reference DMRs is located in a region and/or gene being SEQ ID NO 52 of WO 2011/034631 (SEQ ID NO.: 66 of the present application) and another of said reference DMRs is located in a region and/or gene being SEQ ID NO.: 118 of WO 2011/034631 (SEQ ID NO.: 102 of the present application)

TABLE C shows the conversion of the sequence identifiers used in the WO 2011/034631 and WO 2011/092592 to the sequence identifiers used in the present invention.

TABLE C

Conversion table for sequence identifiers

| SEQ ID NO.: Present invention | SEQ ID NO.: WO 2011/034631 | SEQ ID NO.: WO 2011/092592 |
|---|---|---|
| SEQ ID NO.: 15 | 1 | — |
| SEQ ID NO.: 16 | 2 | — |
| SEQ ID NO.: 17 | 3 | — |
| SEQ ID NO.: 18 | 4 | — |
| SEQ ID NO.: 19 | 5 | — |
| SEQ ID NO.: 20 | 6 | — |
| SEQ ID NO.: 21 | 7 | — |
| SEQ ID NO.: 22 | 8 | — |
| SEQ ID NO.: 23 | 9 | — |
| SEQ ID NO.: 24 | 10 | — |
| SEQ ID NO.: 25 | 11 | — |
| SEQ ID NO.: 26 | 12 | — |
| SEQ ID NO.: 27 | 13 | — |
| SEQ ID NO.: 28 | 14 | — |
| SEQ ID NO.: 29 | 15 | — |
| SEQ ID NO.: 30 | 16 | — |
| SEQ ID NO.: 31 | 17 | — |
| SEQ ID NO.: 32 | 18 | — |
| SEQ ID NO.: 33 | 19 | — |
| SEQ ID NO.: 34 | 20 | — |
| SEQ ID NO.: 35 | 21 | — |
| SEQ ID NO.: 36 | 22 | — |
| SEQ ID NO.: 37 | 23 | — |
| SEQ ID NO.: 38 | 24 | — |
| SEQ ID NO.: 39 | 25 | — |
| SEQ ID NO.: 40 | 26 | — |
| SEQ ID NO.: 41 | 27 | — |
| SEQ ID NO.: 42 | 28 | — |
| SEQ ID NO.: 43 | 29 | — |
| SEQ ID NO.: 44 | 30 | — |
| SEQ ID NO.: 45 | 31 | — |
| SEQ ID NO.: 46 | 32 | — |
| SEQ ID NO.: 47 | 33 | — |
| SEQ ID NO.: 48 | 34 | — |
| SEQ ID NO.: 49 | 35 | — |
| SEQ ID NO.: 50 | 36 | — |
| SEQ ID NO.: 51 | 37 | — |
| SEQ ID NO.: 52 | 38 | — |
| SEQ ID NO.: 53 | 39 | — |
| SEQ ID NO.: 54 | 40 | — |
| SEQ ID NO.: 55 | 41 | — |
| SEQ ID NO.: 56 | 42 | — |
| SEQ ID NO.: 57 | 43 | — |
| SEQ ID NO.: 58 | 44 | — |
| SEQ ID NO.: 59 | 45 | — |
| SEQ ID NO.: 60 | 46 | — |
| SEQ ID NO.: 61 | 47 | — |
| SEQ ID NO.: 62 | 48 | — |
| SEQ ID NO.: 63 | 49 | — |
| SEQ ID NO.: 64 | 50 | — |
| SEQ ID NO.: 65 | 51 | — |
| SEQ ID NO.: 66 | 52 | — |
| SEQ ID NO.: 67 | 53 | — |
| SEQ ID NO.: 68 | 54 | — |
| SEQ ID NO.: 69 | 55 | — |
| SEQ ID NO.: 70 | 56 | — |
| SEQ ID NO.: 71 | 57 | — |
| SEQ ID NO.: 72 | 58 | — |
| SEQ ID NO.: 73 | 59 | — |
| SEQ ID NO.: 74 | 90 | — |
| SEQ ID NO.: 75 | 91 | — |
| SEQ ID NO.: 76 | 92 | — |
| SEQ ID NO.: 77 | 93 | — |
| SEQ ID NO.: 78 | 94 | — |
| SEQ ID NO.: 79 | 95 | — |
| SEQ ID NO.: 80 | 96 | — |
| SEQ ID NO.: 81 | 97 | — |
| SEQ ID NO.: 82 | 98 | — |
| SEQ ID NO.: 83 | 99 | — |
| SEQ ID NO.: 84 | 100 | — |
| SEQ ID NO.: 85 | 101 | — |
| SEQ ID NO.: 86 | 102 | — |
| SEQ ID NO.: 87 | 103 | — |
| SEQ ID NO.: 88 | 104 | — |
| SEQ ID NO.: 89 | 105 | — |

TABLE C-continued

Conversion table for sequence identifiers

| SEQ ID NO.: Present invention | SEQ ID NO.: WO 2011/034631 | SEQ ID NO.: WO 2011/092592 |
|---|---|---|
| SEQ ID NO.: 90 | 106 | — |
| SEQ ID NO.: 91 | 107 | — |
| SEQ ID NO.: 92 | 108 | — |
| SEQ ID NO.: 93 | 109 | — |
| SEQ ID NO.: 94 | 110 | — |
| SEQ ID NO.: 95 | 111 | — |
| SEQ ID NO.: 96 | 112 | — |
| SEQ ID NO.: 97 | 113 | — |
| SEQ ID NO.: 98 | 114 | — |
| SEQ ID NO.: 99 | 115 | — |
| SEQ ID NO.: 100 | 116 | — |
| SEQ ID NO.: 101 | 117 | — |
| SEQ ID NO.: 102 | 118 | — |
| SEQ ID NO.: 103 | 119 | — |
| SEQ ID NO.: 104 | 120 | — |
| SEQ ID NO.: 105 | 121 | — |
| SEQ ID NO.: 106 | 122 | — |
| SEQ ID NO.: 107 | 123 | — |
| SEQ ID NO.: 108 | 124 | — |
| SEQ ID NO.: 109 | 125 | — |
| SEQ ID NO.: 110 | 126 | — |
| SEQ ID NO.: 111 | 127 | — |
| SEQ ID NO.: 112 | 128 | — |
| SEQ ID NO.: 113 | 129 | — |
| SEQ ID NO.: 114 | 130 | — |
| SEQ ID NO.: 115 | 131 | — |
| SEQ ID NO.: 116 | 132 | — |
| SEQ ID NO.: 117 | 133 | — |
| SEQ ID NO.: 118 | 134 | — |
| SEQ ID NO.: 119 | 135 | — |
| SEQ ID NO.: 120 | 136 | — |
| SEQ ID NO.: 121 | 137 | — |
| SEQ ID NO.: 122 | 138 | — |
| SEQ ID NO.: 123 | 139 | — |
| SEQ ID NO.: 124 | 140 | — |
| SEQ ID NO.: 125 | 141 | — |
| SEQ ID NO.: 126 | 142 | — |
| SEQ ID NO.: 127 | 143 | — |
| SEQ ID NO.: 128 | 144 | — |
| SEQ ID NO.: 129 | 145 | — |
| SEQ ID NO.: 130 | 146 | — |
| SEQ ID NO.: 131 | 147 | — |
| SEQ ID NO.: 132 | 148 | — |
| SEQ ID NO.: 133 | 149 | — |
| SEQ ID NO.: 134 | 150 | — |
| SEQ ID NO.: 135 | 151 | — |
| SEQ ID NO.: 136 | 152 | — |
| SEQ ID NO.: 137 | 153 | — |
| SEQ ID NO.: 138 | 154 | — |
| SEQ ID NO.: 139 | 155 | — |
| SEQ ID NO.: 140 | 156 | — |
| SEQ ID NO.: 141 | 157 | — |
| SEQ ID NO.: 142 | 158 | — |
| SEQ ID NO.: 143 | 159 | — |
| SEQ ID NO.: 144 | 160 | — |
| SEQ ID NO.: 145 | 161 | — |
| SEQ ID NO.: 146 | 162 | — |
| SEQ ID NO.: 147 | 163 | — |
| SEQ ID NO.: 148 | 176 | — |
| SEQ ID NO.: 149 | 179 | — |
| SEQ ID NO.: 150 | 180 | — |
| SEQ ID NO.: 151 | 184 | — |
| SEQ ID NO.: 152 | 188 | — |
| SEQ ID NO.: 153 | 189 | — |
| SEQ ID NO.: 154 | 190 | — |
| SEQ ID NO.: 155 | 191 | — |
| SEQ ID NO.: 156 | 193 | — |
| SEQ ID NO.: 157 | 195 | — |
| SEQ ID NO.: 158 | 198 | — |
| SEQ ID NO.: 159 | 199 | — |
| SEQ ID NO.: 160 | 200 | — |
| SEQ ID NO.: 161 | 201 | — |
| SEQ ID NO.: 162 | 202 | — |
| SEQ ID NO.: 163 | 203 | — |
| SEQ ID NO.: 164 | 205 | — |
| SEQ ID NO.: 165 | 206 | — |
| SEQ ID NO.: 166 | 207 | — |
| SEQ ID NO.: 167 | 208 | — |
| SEQ ID NO.: 168 | 209 | — |
| SEQ ID NO.: 169 | 210 | — |
| SEQ ID NO.: 170 | 211 | — |
| SEQ ID NO.: 171 | 212 | — |
| SEQ ID NO.: 172 | 213 | — |
| SEQ ID NO.: 173 | 214 | — |
| SEQ ID NO.: 174 | 221 | — |
| SEQ ID NO.: 175 | 223 | — |
| SEQ ID NO.: 176 | 225 | — |
| SEQ ID NO.: 177 | 226 | — |
| SEQ ID NO.: 178 | 231 | — |
| SEQ ID NO.: 179 | 232 | — |
| SEQ ID NO.: 180 | 233 | — |
| SEQ ID NO.: 181 | 235 | — |
| SEQ ID NO.: 182 | 239 | — |
| SEQ ID NO.: 183 | 241 | — |
| SEQ ID NO.: 184 | 257 | — |
| SEQ ID NO.: 185 | 258 | — |
| SEQ ID NO.: 186 | 259 | — |
| SEQ ID NO.: 187 | 261 | — |
| SEQ ID NO.: 188 | — | 33 |
| SEQ ID NO.: 189 | — | 34 |
| SEQ ID NO.: 190 | — | 35 |
| SEQ ID NO.: 191 | — | 36 |
| SEQ ID NO.: 192 | — | 37 |
| SEQ ID NO.: 193 | — | 38 |
| SEQ ID NO.: 194 | — | 39 |
| SEQ ID NO.: 195 | — | 40 |
| SEQ ID NO.: 196 | — | 41 |
| SEQ ID NO.: 197 | — | 42 |
| SEQ ID NO.: 198 | — | 43 |
| SEQ ID NO.: 199 | — | 44 |

If two DMRs are used that are located on the same chromosome, then in particular embodiments of all aspects of the present invention, they are not located in the same portion of the genomic and/or gene. For example, such DMRs may be separated by more than about 20 kb, or more than about 15 kb, 10 kb, 8 kb, 6 kb, 4 kb, 2 kb, 1 kb, 500 bp or 200 bp. Alternatively, it is envisioned, that when two (or more) DMRs are used in the present invention that are located on the same chromosome, they may, in certain embodiments, be located in the same region or gene (such as one described herein) and, further, may overlap with each other.

In particular embodiments of the present invention, when two of said reference DMRs are used (or more than two reference DMRs are being used) at least one (preferable each) of said reference DMRs is located in a portion of the genome and/or gene (preferably that is human) that is RASSF1A and/or TBX3 and/or PCDHGA1 or a DNA sequence of no more than 10 kbp, 5 kbp, 1 kbp, 500 bp, 250 bp, 150 bp, 100 bp or 50 bp upstream and/or downstream from such region and/or gene; and/or at least one (preferable each) of said reference DMRs is located between about positions 4,700 bp and 5,600 bp of RASSF1A (NCBI Reference Sequence: NG_023270.1: *Homo sapiens* Ras association (RalGDS/AF-6) domain family member 1 (RASSF1), RefSeqGene on chromosome 3; SEQ ID NO.: 13); and/or is located between about positions 1,660 bp and 2,400 bp of TBX3 (NCBI Reference Sequence: NG_008315.1: *Homo sapiens* T-box 3 (TBX3), RefSeqGene on chromosome 12; SEQ ID NO.: 14) and/or is located in PCDHGA1 between 141,330,571 to 141,512,981, of NCBI Reference Sequence *Homo sapiens* chromosome 5, GRCh38.p2 Primary Assembly: NC_000005.10 GI:568815593; SEQ ID No.: 217), or between about 141,492,450 to 141,492,750 or 141,492,550 to 141,492,700 or 141,492,580 to 141,492,7690 of such sequence. In more particular embodiments: (i) one reference DMR comprises one located between about positions 4,700 bp and 5,600 bp of RASSF1A and a second reference DMR comprises one located between about positions 1,660 bp and 2,400 bp of TBX3: or (ii) one reference DMR comprises one located between about positions about 141,492,450 to 141,492,750 or 141,492,550 to 141,492,700 or 141,492,580 to 141,492,7690 of PCDHGA1 (NCBI Reference Sequence *Homo sapiens* chromosome 5, GRCh38.p2 Primary Assembly: NC_000005.10 GI:568815593) and a second reference DMR comprises one located between about positions 1,660 bp and 2,400 bp of TBX3.

In particular embodiments, a reference DMR is located in RASSF1A between about positions 4,900 bp and 5,500 bp, 5,000 bp and 5,400 bp, or 5,100 bp and 5,300 bp of RASSF1A; and/or is located in TBX3 between about positions 1,800 bp and 2,260 bp, 1,920 bp and 2,160 bp or 1,920 bp and 2,080 bp of TBX3 (such as SEQ ID No.: 203); and/or is located in DSCAM between about positions 40,841,600 bp and 40,841,900 bp, 40,841,625 bp and 40,841,840 bp or 40,841,650 bp and 40,841,790 bp; and/or is located between about positions 141,492,450 to 141,492,750, 141,492,550 to 141,492,700 or 141,492,585 to 141,492,690 of PCDHGA1 (NCBI Reference Sequence *Homo sapiens* chromosome 5, GRCh38.p2 Primary Assembly: NC_000005.10 GI:568815593) such as SEQ ID No.: 221.

In particular embodiments of the present invention, when two of said first (or second) target DMRs are used (or more than two first or second target DMRs are being used) at least one (preferable each) of said first (or second) target DMRs is located in a portion of the genome and/or gene (preferably that is human) that is DSCAM and/or C21orf57, or a DNA sequence of no more than 10 kbp, 5 kbp, 1 kbp, 500 bp, 250 bp, 150 bp, 100 bp or 50 bp upstream and/or downstream from such region and/or gene; and/or at least one (preferable each) of said first (or second) target DMRs is located between about positions 40,841,584 and 40,842,020 of DSCAM; (Down Syndrome Cell Adhesion Molecule; NCBI Reference Sequence *Homo sapiens* chromosome 21, GRCh38.p2 Primary Assembly: NC_000021.9 GI:568815577, region 40,010,999 to 40,847,113; SEQ ID No.: 200); and/or is located within no more than 10 kbp, 5 kbp, 1 kbp, 500 bp, 250 bp, 150 bp, 100 bp or 50 bp upstream and/or downstream from C21orf57 (YBEY; Chromosome 21: 46,286,337-46,297,751 forward strand, GRCh38:CM000683.2; such gene, including 250 bp upstream/downstream flaking regions, SEQ ID No.: 218); and/or is located within no more than 10 kbp, 5 kbp, 1 kbp, 500 bp, 250 bp, 150 bp, 100 bp or 50 bp upstream and/or downstream from C21orf29 (thrombospondin type laminin G domain and EAR repeats, TSPEARM; HGNC:1268; Chromosome 21: 44,497,892-44,711,580 reverse strand, GRCh38:CM000683.2); and/or is located within no more than 10 kbp, 5 kbp, 1 kbp, 500 bp, 250 bp, 150 bp, 100 bp or 50 bp upstream and/or downstream from CGI149 (charged multivesicular body protein 3, CHMP3; HGNC: 29865; Chromosome 2: 86,503,431-86,563,479 reverse strand, GRCh38:CM000664.2).

In particular embodiments, a first (or second) target DMR is located in in DSCAM between about positions 40,841,600 bp and 40,841,900 bp, 40,841,625 bp and 40,841,840 bp or 40,841,650 bp and 40,841,790 bp of DSCAM (with reference to *Homo sapiens* chromosome 21, GRCh38.p2 Primary Assembly: NC_000021.9 GI:568815577, region), such as SEQ ID No.: 201; and/or is located within about 200 bp, 150 bp, or 100 bp upstream or downstream of C21orf57, such as between about positions 46,297,700 to 46,297,940, 46,297,750 to 46,297,900 or 46,297,790 to 46,297,890 of Chromosome 21 forward strand, GRCh38:CM000683.2, such as SEQ ID No.: 219; and/or is located within about 200 bp, 150 bp, or 100 bp upstream or downstream of C21orf29, such as between about positions 44,709,100 to 44,709,900, 44,709,300 to 44,709,700 or 44,709,400 to 44,709,600 of Chromosome 21 forward strand, GRCh38:CM000683.2, such as SEQ ID No.: 231; and/or or is located within about 200 bp, 150 bp, or 100 bp upstream or downstream of CGI149, such as between about positions 46,667,100 to 46,667,950, 46,667,300 to 46,667,750 or 46,667,400 to 46,667,650 of Chromosome 21 forward strand, GRCh38:CM000683.2, such as SEQ ID No.: 232.

By way of one non-limiting example, in one embodiment of the present invention: (i) one of said first target DMRs is located in DSCAM and another of said first target DMRs is located in C21orf57 (or in C21orf29 or CGI149) or a DNA sequence of no more than 10 kbp, 5 kbp, 1 kbp, 500 bp, 250 bp, 150 bp, 100 bp or 50 bp upstream and/or downstream from such region and/or gene; and (ii) one of said reference DMRs is located in TBX3 and another of said reference DMRs is located in PCDHGA1 or a DNA sequence of no more than 10 kbp, 5 kbp, 1 kbp, 500 bp, 250 bp, 150 bp, 100 bp or 50 bp upstream and/or downstream from such region and/or gene. In particular of such embodiments: (i) one of said first target DMRs comprises SEQ ID No No.: 201 and another of said first target DMRs comprises SEQ ID No.: 219 (or SEQ ID No.: 231 or 232); and (ii) one of said reference DMRs comprises SEQ ID No.: 203 and another of said reference DMRs comprises SEQ ID No.: 220.

Figure 2:
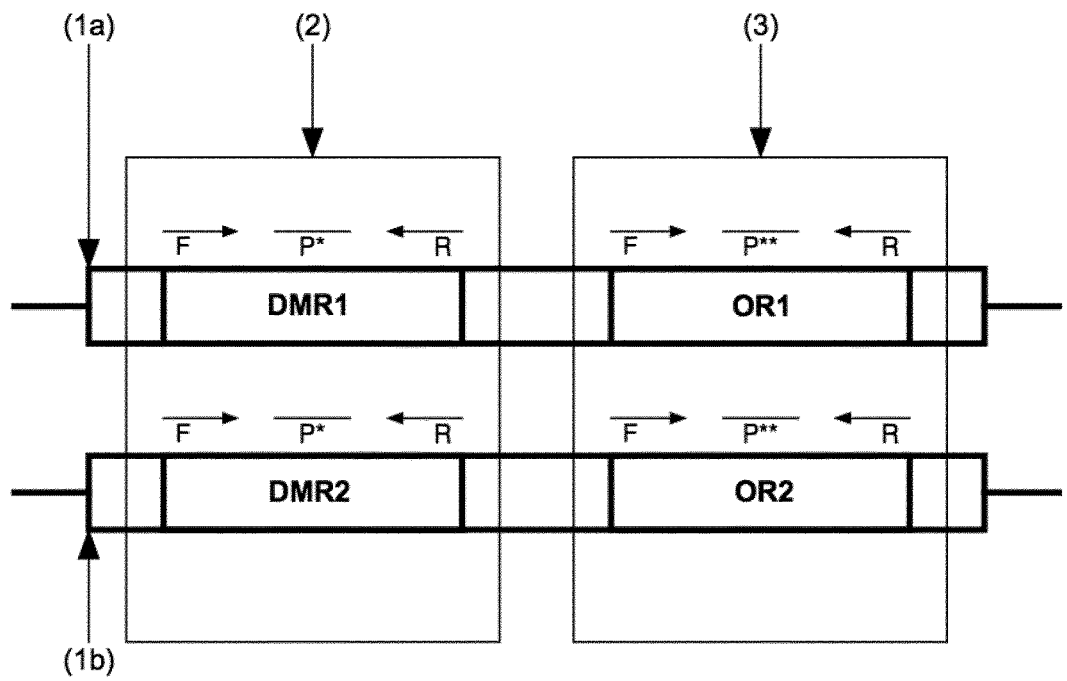
FIG. 2 depicts a schematic representation of the differentially methylated regions ("DMR") and other regions ("OR") used in Example 1.

The general arrangement of the DMRs and other regions ("OR") of the differential methylation-based DNA detection used in EXAMPLE 1, is graphically represented by FIG. 2: (1a) DMR1 is found in exon 2 of RASSF1A and OR1 is located within exon 4 of RASSF1A, with DMR1 located between positions 50,340,672 bp and 50,340,784 bp and OR1 located between positions 50,331,604 bp and 50,331,702 bp of the RASS1A genomic sequence (NCBI Reference Sequence: NC_000003.12 *Homo sapiens* chromosome 3, GRCh38 Primary Assembly), separating DMR1 and OR1 by a distance of 8,969 bp. (1b) DMR2 is found in the promoter region of TBX3, with DMR2 located between positions 114,687,095 bp and 114,687,189 bp and OR2 is located between positions 114,676,384 bp and 114,676,454 bp of the TBX3 genomic sequence (NCBI Reference Sequence: NC_000012.12 *Homo sapiens* chromosome 12, GRCh38 Primary Assembly), separating DMR2 and OR2 by a distance of 10,640 bp. (2) Methylation in DNA at the two DMRs is detected using probe-based quantitative PCR using the respective forward (F) and reverse (R) PCR primers and region-specific probes, each probe labelled with the same labels (P*). (3) Total DNA is detected at two ORs using probe-based quantitative PCR using the respective forward (F) and reverse (R) PCR primers and region-specific probes, each probe labelled with the same labels for the ORs that is different to the labels used for the two DMRs (P**). Details of primer and probe sequences and probe labels are set out in TABLE 1.

The general arrangement of the DMRs and other regions ("OR") used in one non-limiting embodiment of the present invention, is graphically represented by FIG. 6: (1a) one first target DMR (DMR1) is found in eg DSCAM (Down Syndrome Cell Adhesion Molecule; NCBI Reference Sequence *Homo sapiens* chromosome 21, GRCh38.p2 Primary Assembly: NC_000021.9 GI:568815577, region 40,010,999 to 40,847,113; SEQ ID No.: 200) such as one located in SEQ ID No.: 51, and (1b) another first target DMR (DMR2) is found in a region no more than 250 pb upstream or downstream of eg C21orf57 (YBEY; Chromosome 21: 46,286, 337-46,297,751 forward strand, GRCh38:CM000683.2; such gene, including 250 bp upstream/downstream flaking regions, SEQ ID No.: 218) such as one located in SEQ ID No.: 185; (1') a first reference DMR (DMR1') is found in in the promoter region of TBX3 (such as one located in SEQ ID No.: 66) and OR1' is located in TBX3 (on human chromosome 12 (2a'), with DMR1' located between positions 114,687,093 bp and 114,687,191 bp and OR1' located between positions 114,676,384 bp and 114,676,454 of the TBX3 genomic sequence (NCBI Reference Sequence: NC_000012.12 *Homo sapiens* chromosome 12, GRCh38 Primary Assembly), separating DMR1' and OR1' by a distance between about 10,600 bp and 10,810 bp (4a'); and a second reference DMR (DMR2') is found in PCDHGA1 (such as one located in SEQ ID No.: 102) and OR2' is located in PCDHGA1 (on human chromosome 5 (2b'), with DMR2' located between positions 141,492,593-141,492,687 and OR2' located between positions 141,492,918-141,493, 009 of the PCDHGA1 genomic sequence (NCBI Reference Sequence *Homo sapiens* chromosome 5, GRCh38.p2 Primary Assembly: NC_000005.10 GI:568815593); separating DMR2' and OR2' by a distance between about 300 pb (4b'). Alternative (1a) DMR1s and/or (1b) DMR2s may be found: (x) in a region no more than 250 pb upstream or downstream of eg C21orf29 (TSPEARM; HGNC:1268; Chromosome 21: 44,497,892-44,711,580 reverse strand, GRCh38: CM000683.2); such as one located in SEQ ID No.: 231; or (y) in a region no more than 250 pb upstream or downstream of eg CGI149 (CHMP3; HGNC:29865; Chromosome 2: 86,503,431-86,563,479 reverse strand, GRCh38: CM000664.2), such as one located in SEQ ID No.: 232)

In the embodiment of the present invention graphically represented by FIG. 6, each of the two first target DMRs are detected with the different detectable label(s) (1a) and (1b); the two reference DMRS (DRM1' and DMR 2') are detected with the same detectable label(s) (1'); and the optional two ORs (OR1' and OR2') are detected with the same detectable label(s) (3').

Certain embodiments of the present invention, in the context of the methods, compositions, kits (or components thereof) and/or computer program product thereof, comprise or comprise the use of one or more of the foregoing DMRs, ORs, sequences of the primers and/or probes, in particular any of those set forth in TABLE 1, TABLE D or TABLE 5, or TABLE E, TABLE 8 or TABLE 10. In certain of such embodiments, a given probe comprises a sequence set forth in TABLE 1, TABLE D or TABLE 5, or TABLE E, TABLE 8 or TABLE 10 and any one of the label and quencher pairs (optionally, with a minor binding groove moiety) as set forth in TABLE 1, TABLE D or TABLE 5, or TABLE E, TABLE 8 or TABLE 10. In particular, the probe may comprise the combination of the sequence with the label and quencher pair (optionally, with the minor binding groove moiety) as set forth in TABLE 1, TABLE D or TABLE 5, or TABLE E, TABLE 8 or TABLE 10 for such probe. Other embodiments of the present invention, particularly in the context of the methods, compositions, kits (or components thereof) and/or computer program product thereof, comprise or comprise the use of the specific combination of two or more (for example, of all) the foregoing DMRs, ORs, sequences of the primers and/or probes, in particular the combination of the primers/probes as set forth in TABLE 1 and/or the combination of the primers/probes as set forth in TABLE 5, including a primer or probe from TABLE D; more particularly the combination of the primers/probes as set forth TABLE E for assay version V10.3.

The term "methylation site(s)" will be art-recognised, and has a meaning that encompasses, for example, a CpG motif within a short nucleotide sequence (eg one that is 4, 6, 8, 10 or 12 bp in length) that is, preferably, recognised by a methylation-sensitive restriction enzyme, such as one disclosed elsewhere herein.

Analogously, and particularly in the context of those embodiments of the present invention that utilise one or more OR, the OR, when located in particular portions and/or genes of the genome, may be located in a promoter, enhancer region or an exon of a gene, or alternatively, located in an intron of such a gene, or in a non-coding region of the genome. In particular embodiments of all aspects of the present invention, such genome and/or gene is a human genome or gene. In particular embodiments, when an OR is used in the present invention and is located in the same portion of the genome and/or gene that features one or more DMRs (preferably, non-overlapping with a DMR used in the invention), then it is located in a portion of the genome and/or gene such as a gene (eg human, and/or in particular when said species of DNA is foetal cfDNA) that is RASSF1A and/or TBX3 and/or PCDHGA1 or a DNA sequence of no more than 10 kbp, 5 kbp, 1 kbp, 500 bp, 250 bp, 150 bp, 100 bp or 50 bp upstream and/or downstream from such region and/or gene, or is selected from the group consisting of: RASSF1A, TBX3, HLCS, ZFY, CDC42EP1, PCDHGA1, MGC15523, SOX14 and SPN and DSCAM and C21orf57 and C21orf29 and CGI149 or a DNA sequence of no more than 10 kbp, 5 kbp, 1 kbp, 500 bp, 250 bp, 150 bp, 100 bp or 50 bp upstream and/or downstream from such region and/or gene. When not co-located with a DMR (for example, when a second or multiple other region is used), then such other region may, in certain embodiments, be located in a (eg human) housekeeping gene (such as GAPDH, beta-actin, ALB, APOE or RNASEP). Analogously, and particularly in the context of other embodiments of the present invention that use one or more OR, the OR may be located in particular portions and/or genes of the genome, and may be located in a promoter, enhancer region or an exon of a gene, or alternatively, located in an intron of such a gene, or in a non-coding region of the genome. In particular such embodiments of all aspects of the present invention, such genome and/or gene is a human genome or gene. In particular embodiments, an OR used in the present invention is located in a (eg human) housekeeping gene (such as GAPDH, beta-actin, ALB, APOE or RNASEP) or a DNA sequence of no more than 10 kbp, 5 kbp, 1 kbp, 500 bp, 250 bp, 150 bp, 100 bp or 50 bp upstream and/or downstream from such region and/or gene. Alternatively said OR may be located in the same portion of the genome and/or gene that feature one or more DMRs (such as those located RASSF1A, TBX3, HLCS, ZFY, CDC42EP1, PCDHGA1, MGC15523, SOX14 or SPN or DSCAM or PCDHGA1 or a DNA sequence of no more than 10 kbp, 5 kbp, 1 kbp, 500 bp, 250 bp, 150 bp, 100 bp or 50 bp upstream and/or downstream from such region and/or gene), and preferably does not overlap with a DMR used in the invention.

In particular embodiments of all aspects of the invention that use one or more OR, said OR comprises a portion of the genome without a methylation site specific for said reagent, and said OR is located in the (eg human) genes RASSF1A or TBX3 (eg SEQ ID NOs: 13 and 14 respectively) or DSCAM (SEQ ID No.: 200) or PCDHGA1 (SEQ ID No.: 217) or C21orf57 (such gene including 250 bp upstream/downstream flaking regions SEQ ID No.: 218) or C21orf29 or CGI149 or a DNA sequence of no more than 10 kbp, 5 kbp, 1 kbp, 500 bp, 250 bp, 150 bp, 100 bp or 50 bp upstream and/or downstream from such region and/or gene, and includes more particular embodiments wherein two or more of said other regions are used in detection step (c) and the first other region is located between about positions 14,220 bp and 13,350 bp of such RASSF1A and the second other region is located between about positions 12,400 bp and 13,000 bp of such TBX3. In particular embodiments, an other region is located in RASSF1A between about positions 14,230 bp and 14,340 bp, 14,230 bp and 14,330 bp, 14,230 bp and 14,320 bp, or 14,230 bp and 14,310 bp of such RASSF1A; and/or is located in TBX3 between about positions 12,400 bp and 12,940 bp, 12,700 bp and 12,850 bp or 12,710 bp and 12,790 bp of such TBX3 (such as SEQ ID No.: 204); and/or is located in DSCAM between about positions 40,841,150 bp and 40,841,525 bp, 40,841,200 bp and 40,841,475 bp or 40,841,250 bp and 40,841,425 bp of DSCAM (with reference to Homo sapiens chromosome 21, GRCh38.p2 Primary Assembly: NC_000021.9 GI:568815577, region), such as SEQ ID No.: 202; and/or is located in PCDHGA1 between about positions 141,492,800-141,493,100, 141,492,850-141,493,050, 141,492,900-141,493,020, 141,492,918-141,493,009 of PCDHGA1 (NCBI Reference Sequence Homo sapiens chromosome 5, GRCh38.p2 Primary Assembly: NC_000005.10), such as SEQ ID No.: 221. Alternatively, an OR may be located in an exon such as between about positions 13,790 bp and 13,880 bp, or 14,490 bp and 14,600 bp of such RASSF1A, or between about positions 8,040 bp and 8,180 bp or 6,230 bp and 6,350 bp of such TBX3; or an OR may be located in an intron such as between about positions 10,500 bp and 11.90 bp of such RASSF1A, or between about positions 10,000 bp and 11,000 bp of such TBX3. Alternatively, an OR may be located in DSCAM, such as the sequence TCCGTGTGCTCCACCCTTTGAATTCAGAACGACAT-AGTGGATACTCCGTGGGGCTGCTGGAATCTTCCaT-TCcCACT GCCTTATCTT (SEQ ID NO.: 202), which may be amplified and detected with the following probes and primers:

TABLE D

Primer and probes for a DSCAM OR

| Chr. | Gene/Region | Component | Sequence (5'-3')** | SEQ ID No.* |
|---|---|---|---|---|
| 21 | DSCAM Other region | Chr21OR-For | TCCGTGTGCTCCACCCTTTG | 208 |
| | | Chr21OR-Rev | AAGATAAGGCAGTGGGAATGGAAG | 209 |
| | | Chr21OR-Probe | [Cy5]-CCAGCAGCCCCACGGAGTATCC-[BHQ3] | 210 |

*Only nucleotide sequence listed, without dyes/quenchers
**The dyes/quenchers used for each probe are shown in "[ ]" parentheses

TABLE E

Primer and probes for demonstrated assays of EXAMPLE 10

| Chr. | Gene/Region | Component | Sequence (5'-3')** | Assay | SEQ ID NO.* |
|---|---|---|---|---|---|
| 21 | DSCAM DMR | Chr21DMR1-For | attggaaggt cagccaatca gg | V10.1 | 205 |
| | | Chr21DMR1-Rev | tccaaagccg cgagggaac | V10.1 | 206 |
| | | Chr21DMR1-Probe | [LCRed610]-cgcctcggag gtggcagctc-[BBQ650] | V10.1 | 207 |
| 21 | C21orf57 DMR | Chr21DMR2-For | cgagccgtgg catcga | V10.1 | 222 |
| | | Chr21DMR2-Rev | ccttgaaggg cgagagg | V10.1 | 223 |
| | | Chr21DMR2-Probe | [Cy5]-cgttccctga actccagacg c-[BHQ3] | V10.1 | 224 |
| 12 | TBX3 DMR | Chr12DMR-For | aaggtgcgaa ctcctctttg tc | V10.1 | 211 |
| | | Chr12DMR-Rev | aattaatcac ccagcgcatg gc | V10.1 | 212 |
| | | Chr12DMR-Probe | [6FAM]-cccctcccgg tgggtgataa acc-[Eclipse] | V10.1 | 213 |
| 12 | TBX3 OR | Chr12OR-For | tgttcactgg aggactcatc | V10.1 | 214 |
| | | Chr12OR-Rev | cagtccatga gggtgtttg | V10.1 | 215 |
| | | Chr12OR-Probe | [LCCyan500]-aggtcccatt ctcctttttg tgtctttc-[BHQ1] | V10.1 | 216 |
| 5 | PCDHGA1 DMR | Chr5DMR-For | agcgactgcc gctctaa | V10.1 | 225 |
| | | Chr5DMR-Rev | tcgccgaccc ttgagac | V10.1 | 226 |
| | | Chr5DMR-Probe | [6FAM]-tctggcccaa ggatcgtaga gtcc-[Eclipse] | V10.1 | 227 |

TABLE E-continued

Primer and probes for demonstrated assays of EXAMPLE 10

| Chr. | Gene/ Region | Component | Sequence (5'-3')** | Assay | SEQ ID NO.* |
|---|---|---|---|---|---|
| 5 | PCDHGA1 OR | Chr5OR-For Chr5OR-Rev Chr5OR-Probe | gcgatctagg gtcagagatt tg cagagcctat agctttccat ctg [LCCyan500]-acactctaac aagtcctgtc tcctctgg-[BHQ1] | V10.1 V10.1 V10.1 | 228 229 230 |
| 21 | DSCAM DMR | Chr21DMR1-For Chr21DMR1-Rev Chr21DMR1-Probe | attggaaggt cagccaatca gg tccaaagccg cgagggaac [Cy5]-cgcctcggag gtggcagctc-[BHQ3] | V10.2 V10.2 V10.2 | 205 206 207 |
| 21 | C21orf57 DMR | Chr21DMR2-For Chr21DMR2-Rev Chr21DMR2-Probe | cgagccgtgg catcga ccttgaaggg cgagagg [LCRed610]-cgttccctga actccagacg c-[BBQ650] | V10.2 V10.2 V10.2 | 222 223 224 |
| 5 12 | PCDHGA1 TBX3 | DMR & OR DMR & OR | As V10.1 As V10.1 | V10.2 V10.2 | |
| 21 | DSCAM DMR | Chr21DMR1-For Chr21DMR1-Rev Chr21DMR1-Probe | attggaaggt cagccaatca gg tccaaagccg cgagggaac [LCRed64]-cgcctcggag gtggcagctc-[BHQ650] | V10.3 V10.3 V10.3 | 205 206 207 |
| 21 | C21orf57 DMR | Chr21DMR2-For Chr21DMR2-Rev Chr21DMR2-Probe | cgagccgtgg catcga ccttgaaggg cgagagg [LCRed610]-cgttccctga actccagacg c-[BBQ650] | V10.3 V10.3 V10.3 | 222 223 224 |
| 5 12 | PCDHGA1 TBX3 | DMR & OR DMR & OR | As V10.1 As V10.1 | V10.3 V10.3 | |
| 21 | DSCAM DMR | Chr21DMR1-For Chr21DMR1-Rev Chr21DMR1-Probe | As V10.1 As V10.1 As V10.1 | V10.4 V10.4 V10.4 | |
| 21 | C21orf57 DMR | Chr21DMR3-For Chr21DMR3-Rev Chr21DMR3-Probe | As V10.1 As V10.1 [Cy5]-cgttccctga actccagacg c-[BBHQ650] | V10.4 V10.4 V10.4 | 224 |
| 5 12 | PCDHGA1 TBX3 | DMR & OR DMR & OR | As V10.1 As V10.1 | V10.4 V10.4 | |
| 21 | DSCAM DMR | Chr21DMR1-For Chr21DMR1-Rev Chr21DMR1-Probe | attggaaggt cagccaatca gg tccaaagccg cgagggaac [LCRed610]-cgcctcggag gtggcagctc-[BBQ650] | V10.5 V10.5 V10.5 | 205 206 207 |
| 21 | C21orf29 DMR | Chr21DMR3-For Chr21DMR3-Rev Chr21DMR3-Probe | acttgaatag ccaaatgagt cct cccatgcgcc ttctctg [Cy5]-tcccctctcg tctctcgctt tct-[BHQ3] | V10.5 V10.5 V10.5 | 233 234 235 |
| 5 12 | PCDHGA1 TBX3 | DMR & OR DMR & OR | As V10.1 As V10.1 | V10.5 V10.5 | |
| 21 | DSCAM DMR | Chr21DMR1-For Chr21DMR1-Rev Chr21DMR1-Probe | attggaaggt cagccaatca gg tccaaagccg cgagggaac [LCRed610]-cgcctcggag gtggcagctc-[BBQ650] | V10.6 V10.6 V10.6 | 205 206 207 |
| 21 | CGI149 DMR | Chr21DMR3-For Chr21DMR3-Rev Chr21DMR3-Probe | cgtccggtga gcctaaga ttgtgccacg gttcctaata c [Cy5]-ccgggtgtct gcctctcact ta-[BHQ3] | V10.6 V10.6 V10.6 | 236 237 238 |
| 5 12 | PCDHGA1 TBX3 | DMR & OR DMR & OR | As V10.1 As V10.1 | V10.6 V10.6 | |

*Only nucleotide sequence listed, without dyes/quenchers
**The dyes/quenchers used for each probe are shown in "[ ]" parentheses There is now strong evidence that the level of foetal cfDNA (and/or total cfDNA) present in the circulatory system (eg in plasma) of a pregnant female is a marker of one or more forms of preeclampsia, such as early-onset preeclampsia, mild and/or severe preeclampsia (see Hahn et al 2011, Placenta 32(Supl:517). The present invention shows particular utility in the efficient, effective, sensitive and/or low-variability detection/quantification of foetal cfDNA present in plasma of pregnant females, and the present invention has particular utility therein. Accordingly, in particular embodiments of the present invention, the individual is a pregnant (eg human) female who is susceptible to suffering or developing a pregnancy-associated medical condition; particularly where said pregnancy-associated medical condition is preeclampsia. As used herein, an individual "susceptible to" a medical condition may alternatively be described as "is suspected to" or to "be considered at risk of being susceptible to" suffering or developing a medical condition; and in certain embodiments, the present invention is used to screen and/or diagnose the individual for susceptibility to, risk of suffering or developing, or suffering from or developing, a medical condition.

In alternative embodiments, the individual is a pregnant (eg human) female who is susceptible to (or considered at risk of being susceptible to) suffering or developing a pregnancy-associated medical condition selected from the group consisting of: preterm labour, intrauterine growth retardation and vanishing twin. In particular, by comparison to EXAMPLE 1, the sensitivity of the present invention is such that discrepancies between cfDNA levels determined by the method of the invention and that determined by counts of Y-chromosome sequences as determined by massively parallel sequencing approaches, may be useful in identifying one or more cases of a vanishing twin in (mixed-sex) twin pregnancies that previously were believed to be singleton pregnancies, and/or to follow the relative development and health of one or other of such (mixed-sex) twin pregnancies. The present invention may also be utilised in gender determination of twin pregnancies, by consideration of the relative values for foetal cfDNA compared to counts of Y-chromosome sequences determined from cfDNA (eg by using parallel sequencing approaches). In these regards, it should be noted that approaches that use massively-parallel sequencing of random cfDNA in maternal blood typically always count a very low frequency of "Y-chromosome" sequences (such as between about 0.003% and 0.004% of all sequences, or between about 0.0015% and 0.01% or 0.002% and 0.005% of all sequences) in all female pregnancies due to homology of certain Y-chromosome short sequences to other chromosomes. A cut off of "Y-chromosome" sequence counts of about 0.005%, or between about 0.003%, 0.004%, 0.006% or 0.007%, may therefore be employed for female samples.

In all aspects of the present invention, the reagent that differentially modifies methylated and non-methylated DNA may comprise bisulphite and/or an agent that selectively digests unmethylated over methylated DNA (for example, such agent may digest unmethylated DNA but not methylated DNA). In particular embodiments, the reagent agent comprises: at least one methylation sensitive enzyme; at least one methylation sensitive restriction enzyme; and/or an agent selected from the group consisting of: AatII, AciI, AclI, AfeI, AgeI, AgeI-HF, AscI, AsiSI, AvaI, BceAI, BmgBI, BsaAI, BsaHI, BsiEI. BsiWI, BsmBI, BspDI, BsrFI, BssHII, BstBI, BstUI, ClaI, EagI, FauI, FseI, FspI, HaeII, HgaI, HhaI, HinP1I, HpaII, Hpy99I, HpyCH4IV, KasI, MluI, NaeI, NarI, NgoMIV, NotI, NotI-HF, NruI, Nt.BsmAI, Nt.CviPII, PaeR7I, PluTI, PmlI, PvuI, PvuI-HF, RsrII, SacII, SalI, SalI-HF, SfoI, SgrAI, SmaI, SnaBI, TspMI and ZraI, and Cac8I and PhoI. In particular embodiments, said reagent is one selected from the group consisting of: BstUI, HhaI and HpaII and AciI.

In related embodiments, the reagent may comprise two or more of any of the reagents disclosed herein. For example, it may comprise two, three, four, five or more (eg up to seven, eight or ten) methylation sensitive restriction enzymes, including a reagent comprising or essentially consisting of two or three of the methylation sensitive restriction enzymes selected from the group consisting of: BstUI, HhaI and HpaII The use of bisulphite or methylation-sensitive restriction enzymes to study differential methylation will be well known to the person of ordinary skill, who may apply teachings of standard texts or adaptation of published methods such as Poon et al (2002), Nygren et al (2010) or Yegnasubramanian; et al (2006, Nuc Acid Res 34:e19). By way of illustration, the inventors provide examples herein that employ the use of methylation-sensitive restriction enzymes as the reagent that differentially modifies methylated and non-methylated DNA. For further illustration using bisulphite as reagent, it will be apparent to the person of ordinary skill that bisulphite-modified DNA methylation sites may be detected using eg methylation-specific PCR (such as using primers and/or probes that selectively bind to the bisulphite-modified sequences) and/or by the subsequent use of restriction enzymes the recognition site of which is created upon such bisulphite-modification. Methylation-specific PCR ("MSP") is described by Herman et al (U.S. Pat. No. 6,200,756, EP0954608 and related family members); and a further development of MSP using probe-based PCR (known as "MethylLight") is described by Laird et al (U.S. Pat. No. 6,331,393, EP1185695 and related family members).

In particular embodiments of all aspects of the invention, a quantitative amount of the first or second target species of DNA and/of the reference species if DNA (and/or or said total DNA) is to be detected and/or determined. Accordingly in such embodiments, one or more (eg each) of said detection and/or determination steps comprises quantitative detection and said detected amount of said species of DNA is expressed as a relative concentration of said species of DNA to the total DNA present in said sample. For example, in certain embodiments of the present invention, in each of said determination steps each of said determined amounts of said first target species of DNA, and of said optional second target species of DNA, is expressed as relative concentrations of said first target species of DNA, and of said optional second target species of DNA, in each case to the total DNA in said sample. In those embodiments where a third (or fourth) target species of DNA is detected, then the resent invention also envisions that the amount of such third (or fourth) target species of DNA is expressed as relative concentration.

If an absolute amount of total DNA is known, then correspondingly an absolute amount (for example, as represented by a concentration such as µg/mL or genome-equivalents such as Eg/mL) of any of species of DNA can be determined from such relative concentration. An absolute amount of total DNA for a sample may be determined, for certain embodiments, by including the further steps of: detecting and/or determining an amount of total DNA in a standard sample of DNA of known amount using the same other regions(s) as used in step (c); and comparing the signal detected from said standard sample of DNA to the signal detected in step (c). Such a standard sample of DNA (of known amount/concentration) is readily available from commercial sources, and especially if prepared and analysed using a dilution series, can readily and efficiently be used to determine (by interpolation/estimation from the standard curve) an absolute amount of total DNA present in the sample. Practically, such standard curve may be prepared and analysed essentially as described for an optional OR (but in a separate set of standard vessels/reactions), preferably in the same run as the detection of the DMRs/OR(s); and may even use the same reaction master-mix. Accordingly, while the "DMR(s)" of the DNA control may be detected for such standard DNA, such a signal is not required to generate a standard curve. Accordingly, if the signal from a such a standard DNA sample is used to compare, the in certain embodiments where each of said detection and/or determination steps comprises quantitative detection, said detected amount of said species of DNA can be expressed as an absolute amount of said species of DNA in said sample.

Accordingly, in one embodiment of the method of the present invention, there further comprises the steps of:
determining an amount of DNA in a standard sample of DNA of known amount in respect of the same DMRs as used in step (c) and/or step (d), and/or in optional step (c)' and/or optional step (f); and
comparing each of the signals detected from said standard sample of DNA to the respective signals detected in step in step (c) and/or step (d), and/or in optional step (c)' and/or optional step (f).

In any of the embodiments of the present invention that utilise a standard sample of DNA, there includes certain of such embodiments wherein the standard sample of DNA is a sample of human genomic DNA of known concentration. For example, such human genomic DNA of known concentration may be derived from (such as isolated or purified from) in-vitro cultured human cells, such as those known to have either a euploid or an aneuploidy (such as a T21) complement of chromosomes. In alternative embodiments of the present invention, the standard sample of DNA is a synthetic or engineered sample of DNA of known concentration.

As will be now apparent to the person of ordinary skill, the standard sample of DNA may not be uniformly, appropriately, differentially or otherwise methylated (in particularly if isolated from a human cell-culture). Accordingly, the present invention includes those embodiments where the standard sample of DNA is not treated with the reagent that differentially modifies methylated and non-methylated DNA (such as, a reagent described herein).

In one particular embodiment of the present invention, in each of said determination steps each of said determined amounts of said first target species of DNA, and of said optional second target species of DNA, and of the reference species of DNA, is expressed as an absolute amount of said species of DNA in said sample. However, as one aspect of the invention relates to the comparison of (or consideration of relative amounts or ratios) the determined amounts of one or more (such as two) first target species of DNA (ie the chromosome relevant to the chromosomal aneuploidy) to the determined amounts of the reference species of DNA (ie a reference chromosome), such a comparison can be conducted and does not require the consideration of the absolute amounts. By way of explanation, the ratio of "signal-Target-Chromosome"/"signal-Total-DNA" to "signal-Reference-Chromosome"/"signal-Total-DNA" is, because of mathematical cancelation of the "signal-Total-DNA" component, the same as the ratio of "signal-Target-Chromosome" to "signal-Reference-Chromosome". Accordingly, the present invention also includes embodiments where the identification of the presence (or absence) of the chromosomal aneuploidy present in the foetus is conducted in step (e) without knowledge or consideration of the amount of total DNA present in the sample. For example, the determination in step (e) may be made directly from the Ct (or Cp) numbers generated from qPCR as they inversely correlate with initial concentrations (amounts) of the species of DNA being quantitated.

In certain embodiments of the present invention, a plurality of sets of determinations are made for step (c) and/or step (d), and optional step (c)' and optional step (f), with each set of said determinations made using a different aliquot of DNA of said sample, for example in a different vessel and effectively simultaneously with each other member of the plurality of sets of determinations. Each member of such plurality can be considered a "replicate" of the assay for the same sample (eg, taken from the same pregnant female). Replicates may be efficiently incorporated into the method of the assay by, for example, configuring such a replicate assay to be practiced in a different vessel, such as a different well on the same (or different) microtiter plate such as one used in a qPCR embodiment of the present invention.

In those embodiments of the present invention that use replicates of the samples, said number of replicates for the sample (plurality of sets of determinations) may be between 2 and about 50 (sets), such as between 2 and about 20, between 2 and about 10 or between about 5 and about 15 (sets); preferably wherein said number of replicates (plurality of sets) of determinations is selected from the group consisting of: 2, 3, 4, 5, 6, 7, 8, 9, 10, 11 and 12 (sets of said determinations); in particular between about 3 and 10 sets of said determinations, more particularly about 6 sets of said determinations. For example, for those embodiments of the assay using a mictrotitre plate, the number of replicates may be represented by the method of the present invention being practiced on aliquots of the same sample conducted n such number of (different) wells of such microtiter plate.

Inclusion of replicates in the method, and optionally, their analysis, can provide additional information on eg the robustness, the error or other variability in the method and hence one or more of the amounts of DNA determined therefrom. Indeed, in certain embodiments of the invention that use such replicates, the relative amount(s) or ratio(s) determined in step (e), and/or in optional step (e)', is determined from said plurality of sets of determinations made for step (c) and/or step (d), and/or optional step (c)' and/or optional step (f). Such amount may be determined, in such embodiments, by using an average amount of DNA determined for each set (of replicates), such as a mean, median or mode amount of DNA determined for each set (of replicates), preferably a mean amount of DNA determined for each set (of replicates).

Alternatively, or in addition, the method of the present invention may be practiced (with or without replicates) on a plurality of different samples, each taken from a different pregnant (eg human) female. In such embodiments, especially when in the absence of any molecular tagging methodology, said method is conducted on a plurality of samples each taken from a different pregnant female, each method is conducted in a separate vessel, and effectively simultaneously with each other member of the plurality of samples. As will be now understood by the person of ordinary skill, the method may be practiced on each sample in a different well of eg a microtiter plate.

When practicing the method of the present invention on multiple samples taken from different pregnant females, it may be practiced on a number (plurality) of such different samples being between 2 and about 500 (or more than 500) samples, such as between 2 and about 200, between 2 and about 100 or between about 5 and about 150 samples; preferably wherein said plurality of samples is selected from the group consisting of about: 10, 20, 30, 40, 50, 60, 70, 80, 90, 100,120, and 140 samples (or more than 150 samples); in particular, about 60 samples, each taken from a different pregnant female.

In particular, the practice of the method of multiple samples taken from multiple pregnant (eg human) females, following the disclosure of the present invention, will now be possible for the person of ordinary skill; for example by the use of microtiter-plate based qPCR system such as the LightCycler from Roche. Such multiple of samples may be located in different wells of the same microtiter plate or may be located on different microtiter plates. The inclusion and analysis of such a plurality of samples, especially if in combination with a plurality of replicates for each sample, may enable the identification of the presence (or absence) of the chromosomal aneuploidy to be made with more certainty or confidence. For example, the relative magnitude of the variation in a given sample's determined amounts (eg the standard deviation) for the various replicates compared to the relative magnitude of the variation on amount determined for all (different) samples, can provide additional information in step (e) (or optional step (e)') for the detection of the chromosomal aneuploidy. For example, a large difference in an amount with little relative variation between replicates will give more confidence that a difference from the other samples exists.

The inclusion of multiple samples (and/or replicate) in a single run (eg a microtiter plate) may also provide advantages in enabling the comparison of one run to another run; each run containing at least some different samples. Comparison between runs may also be assisted by the use of control or standard samples common to the different runs, which can enable normalisation of measured or calculated amounts between or across runs. However, with a number of different samples (eg about 10, 20, 30, 40, 50, 60, 70, 80, 90, 100, 130, 140, 150 or more than 150) in each run; in particular, about 60 different samples in each run, amounts determined from one run may be compared to other runs by normalisation methods such those known to the person or ordinary skill or as described elsewhere herein.

One feature of certain embodiments of the present invention is that an amount of the chromosome relevant to the chromosomal aneuploidy is estimated or determined using two (or more) first (or second) target DMRs located on such chromosome. Use and/or consideration of the amounts determined from each of such two (or more) DMRs can provide additional certainty or confidence to an indication of there being a chromosomal aneuploidy present (or absent) in the foetus. For example, if the determined amount in relation to only one target DMR indicates there being present a chromosomal aneuploidy, then this may be considered a less certain or confident indication than a result in which the amounts determined in relation to two (or more) target DMRs indicates there being present a chromosomal aneuploidy.

Accordingly, the present invention includes those embodiments where an amount of the first target species of DNA is determined from the detected amount of methylation at one of the first target DMRs and an amount of the first target species of DNA is determined from the detected amount of methylation at another of the first target DMRs. As will now be apparent, the analogous embodiment may be used for amounts determined from two (or more) of the optional second target DMRs.

In particular of such embodiments, two or more relative amount(s), preferably ratio(s), may be determined in step (e) (and/or optional step (e)') for two or more amounts of first target species of DNA, each in respect of one or more of said first target DMRs.

In certain embodiments, a combined analysis of these two (or more) amounts may be considered, such a mean or median of such two or more amounts. Alternatively, as described herein, in particular embodiments two or more (preferably each) of the relative amount(s) or ratios determined in step (e) (and/or optional step (e)') may be independently or separately used to consider, determine or indicate the presence or absence of the chromosomal aneuploidy in the foetus. Such a "two-dimensional" consideration or analysis may be represented or visualised using a scatter plot such as one shown in FIG. 7; and/or following the use of a large number of different samples and replicates (optionally with normalisation between runs) as one shown in FIG. 8. As will now be apparent, the use of more than two (such as a third) DMR as a target DMR would provide yet further certainty or confidence on the analysis, and the present invention specifically envisions the use of yet additional target DMRs to, eg, provide a "three-dimensional" analysis to further aid the identification of the chromosomal aneuploidy.

Each of the amounts of the target chromosome determined from a first (or second) target DMRs may be considered in relation to a threshold or reference distribution of amounts. In particular, certain embodiments of the present invention are when in step (e) two or more (preferably each) of said relative amount(s) or ratio(s) may be compared with threshold(s) and/or reference distribution(s), wherein two or more (preferably each) of said relative amount(s) or ratio(s) higher or lower than said threshold(s) and/or reference distribution(s) indicates the presence of the chromosomal aneuploidy in the foetus.

As described herein, the threshold(s) and/or reference distribution(s) amount may be identified or provided from external records or information, or may be determined from the use, consideration and/or analysis of multiple samples analysed and amounts determined in accordance with a method of the present invention. Accordingly, in particular embodiments a threshold and/or reference distribution may be determined from a plurality of samples, each sample taken from a different pregnant female, such as by practicing the method as described above on such samples; optionally wherein a replicates (plurality of sets) of determinations are made for step (c) and/or step (d), and optional step (c)' and optional step (f) for each sample such as by practicing the method as set forth herein.

When analysing a plurality of samples and/or replicates in a method of the invention, the samples (and/or replicates) may be arranged in different groups or runs (such as in different microtiter plates in a qPCR experiment). In such embodiments, two or more groups of such plurality of samples/replicates may be analysed on a group-by-group basis, such as each group analysed in a separate run, assay or microtiter plate, and the threshold and/or reference distribution is determined by normalisation of the amount(s) or ratio(s) determined from each group of samples. "Normalisation" can be considered as any suitable method that enables the results (eg the amounts) determined from the samples/replicates of one group to be compared/comparable to those of another group. For example, to be able to compare analyses conducted on one run (or microtiter plate) to those of another run (or microtiter plate). Various normalisation approaches will be available to the person of ordinary skill, including wherein said normalisation between groups of samples may be conducted by considering the difference between a sample-specific amount or ratio (such as a mean of sets of determinations made for such sample) and an average (such as a median) of the amount or ratio determined for all samples in the same group as said specific sample; in particular as described in EXAMPLE 4 and represented in FIG. 8.

Given such numbers of sample-specific amounts, the presence of the chromosomal aneuploidy in the foetus may be indicated by the sample-specific amount or ratio in respect of such foetus that is an outlier compared with threshold(s) and/or reference distribution(s) of amount(s) or ratio(s) determined in respect of to one or more (preferably to two or to each) of the first target DMRs. In particular of such embodiments, the presence of the chromosomal aneuploidy in the foetus may be indicated by the sample-specific amount or ratio in respect of such foetus being located within a numerical cluster located: (a) outside a cluster of sample-specific amounts or ratios in respect of a plurality of other foeti that are (presumed) euploid; and/or (b) within a cluster of sample-specific amounts or ratios in respect of a plurality of other samples representing foeti having the chromosomal aneuploidy; preferably wherein said plurality of other samples representing foeti is selected from the group consisting of about: 2-10, 12-15, 16-25, 26-30, 32-40, 42-50, 52-75, 78-100, 105-125, 130-150, 155-175, 180-200, 205-250, 255-300, 305-350, 355-400, 405-450, 455-500 and more than 500 other such samples. In related embodiments, the cluster may be defined by a circular or ovular shape visualised in a scatter plot of amounts, wherein the coordinates of such circular or ovular shape may be predefined or calculated from the samples analysed in the method. The amount(s) of the target chromosome compared to the reference chromosome determined at two or more target DMRs may then be considered relative to such coordinates, where a sample having amounts that lie within such a boundary are indicative that the chromosomal aneuploidy is present in the foetus carried by the pregnant female from which that sample was taken. As will be apparent, different boundaries may be set so as to identify aneuploidy samples with various degrees of certainty or confidence. For example, those lying closer to the boundary, or lying outside the boundary but within a second boundary (a so-called "grey-zone"), may be subject to further analysis or testing. Indeed, the method of the present invention may be practiced as a pre-screen to prior-art NIPT assays (such as next generation sequencing-based NIPT for aneuploidy) as a means to significantly reduce the number of samples to be tested in such prior-art NIPT assays. For example, the definition of a boundary (such as one being the beginning of a "grey zone") can be used to identify the large number of samples that are negative, ie pregnancies carrying a euploid foetus, and then only test, using the prior-art NIPT assay, the far smaller number of samples that are not clearly negative. Even with a diagnostic assay acting as such a screen having a false positive rate of several percent can provide a highly efficient pre-screen; especially if such assay has a low false negative rate.

In other embodiments, a combination of such cluster/circular/oval analysis with a Z-score analysis may be conducted. For example, such a cluster/circular/oval analysis may be conducted to identify euploid samples and a Z-score analysis (such as one described herein) may be conducted to identify aneuploid samples. Greater certainly on the identification of a chromosomal aneuploidy would then be attributed to a sample that shows concordance with such different analysis techniques.

Prior to or as part of such analysis, one or more of the samples, measures, signals and/or amounts determined from the method are subject to one or more quality control process or steps. For example, the concentration and/or fragmentation pattern of the DNA present in and/or extracted from the sample may be considered prior to step (b) and either the sample not included in the analysis or (in the case of a high concentration) the DNA diluted.

In particular of such embodiments of the present invention, prior to step (b) the concentration of the DNA may be measured eg with a DNF-474 High Sensitivity NGS Kit (Advances Analytical Technologies, Inc.; Ankeny, USA) using a fragment analyser (Advances Analytical Technologies, Inc.; Ankeny, USA). The DNA-concentration of the first significant peak, that may be located around 80 to 220 bp of size and peaks on average at 165 bp, can be determined, which peak can represent the isolated cell-free DNA. In certain embodiments, samples that show a higher DNA-concentration than about 0.3 ng/uL of this peak are diluted to about 0.3 ng/uL. Such dilution may assist to avoid false-positive prediction of samples due to too high amounts of DNA-concentration in comparison to low concentrated samples. Another QC criterion that may applied with such a fragment analysis includes to detect (and eg exclude) thos samples with fragmentation of cell-free DNA (represented for example by jagged peaks that occur at sizes less than about 100 bp) and/or contamination by genomic DNA.

Other possible quality control criteria that may be incorporated into any aspect of the present invention include those where the data from a sample are only included in the analysis if one or more of the following is true:

The number of replicates present of generating data is greater than about four, five, six, seven, or eight; and/or The mean Cp at a qPCR channel for one or more of the DMRs or optional ORs used is less than about 26, 27, 28, 29, 30, 31, 32, 33, 34, 35, 36; and/or The standard deviation of the mean of Cp values at a qPCR channel for one or more of the DMRs or optional ORs used is less than about 0.5, 0.6, 0.7, 0.9, 0.9 or 1.0, or less than about 1.1, 1.2, 1.3, 1.4 or 1.5; and/or All replicates have valid values in all of the qPCR channels the DMRs and optional ORs used; and/or In a fragment analysis, the sample does not show jagged peaks below about 100 bp and/or contamination from genomic DNA; and/or The concentration of cfDNA is greater than about 0.05, 0.1, 0.15, 0.2 ng/uL and/or less than about 0.3, 0.4 or 0.5 ng/uL; and/or The mean Cp at a qPCR channel measuring total DNA is greater than about 22, 24, 25, 26, 27 or 28.

In those embodiments of the present invention in which total DNA (and hence eg, the foetal fraction of cfDNA) present in the sample is determined, as well as the identification of a chromosomal aneuploidy in the foetus, such method of the present invention may be applied for detecting an increased risk of a pregnant female suffering from or developing a pregnancy-associated medical condition.

Accordingly, another aspect of the present invention relates to a method for detecting an increased risk of a pregnant female suffering from or developing a pregnancy-associated medical condition; said method comprising the steps:
(i) conducting a method of the invention as described above;
(ii) determining at least one amount, such as an absolute or relative amount, of foetal DNA present in the sample; and
(iii) comparing the amount of foetal DNA determined with a threshold and/or reference distribution, wherein an increase in, or outlying of, the amount of said foetal of DNA from said threshold and/or reference distribution indicates an increased risk of the pregnant female suffering from or developing said pregnancy-associated medical condition.

Such a risk may instead or additional be assessed by considering: (i) the fold-increase (eg 1.5, 3, 3.5 or 4-fold increase) of foetal cfDNA (determined for such woman compared to a threshold amount), factoring into the determination that for later-term pregnancies a higher fold-increase in foetal cfDNA may be utilised (Zeybek et al 2013, J Obstet Gynaecol Res 39:632); and/or (ii) into which percentile the amount of cfDNA determined from the woman falls, from consideration of a reference distribution of amounts such as those determined from low-risk women or those which did not suffer from or develop preeclampsia, for example if the foetal cfDNA fraction falls within the 90th percentile of such a distribution, then the woman may be considered to have an increased risk of suffering mild or severe preeclampsia (Jakobsen et al 2013, Transfusion 53:1956). Other relevant factors may be considered in determining a suitable threshold amount. For example, a pregnant woman who is also suffering from breast cancer, may have a higher bias of methylation at RASSF1A present in her plasma due to both factors.

Analogously, certain embodiments of such aspect of the present invention further include the step of: comparing the amount of said species of DNA detected with a threshold amount and/or reference distribution of amounts, wherein an amount of said species of DNA in excess to said threshold (or is not an outlier compared to said population) indicates that a diagnosis for an abnormality in the said species of DNA present in said sample may be performed on, preferably a separate aliquot of DNA of, said sample. For example, if foetal cfDNA fraction is greater particular, greater than about 4%, more particularly greater than about 3% foetal cfDNA fraction), then there would be sufficient fraction or foetal cfDNA to effectively conduct a subsequent test to investigate one or more characteristics of the foetal cfDNA, for example to investigate the chance or existence of a chromosomal anomaly of mutation comprised within such foetal cfDNA (such as using NIPT based on massively parallel sequencing). In the case of twin pregnancies, the inventors determine that a minimum foetal fraction of cfDNA for NIPT of a twin pregnancy could be considered to be 8%, or about 5%, 6%, 7%, 9% or 10%, and for monochorionic twin pregnancies with concordant genotypes (apart from rare exceptions, Chen et al, 2013, Am J Med Genet A, 161A:1817), a foetal cfDNA fraction of 4%, or about 2%, 3% or 5%, would be sufficient.

An additional aspect of the present invention relates to certain compositions (eg, one that is useful for, used in or generated as part of a method of the present invention). A composition may be a mixture or other combination of various components. Accordingly, the present invention also related to a composition, said inventive composition comprising two (or more) labelled probes (eg nucleic acid probes, such as those for qPCR), each probe for detecting one or said two or more first target DMRs (such as, one probe for detecting a DMR located in SEQ ID No.: 51 and another probe for detecting a DMR located in SEQ ID No.: 185). In particular such embodiments, two or more or such probes present in the composition are labelled with different detectable label(s). The probes (and labels) may be for any of the first target DMRs disclosed herein, in particular those disclosed in TABLE 1 and/or TABLE 5 and/or TABLE E and/or TABLE 8 and/or TABLE 10. The composition may comprise the probes for detecting two, three, four, five or more than five first target DMRs, and labelled with detectable label(s) as set forth elsewhere herein.

In certain embodiments of such aspect, the composition may further comprise one or more of the following additional components:
two or more pairs of PCR primers, each pair for amplifying one of said two or more first target DMRs, for example for amplifying the first target DMRs for which the probes in the composition are for detecting (such as, one primer pair for amplifying a DMR located in SEQ ID No.: 51 and another primer pair for amplifying a DMR located in SEQ ID No.: 185); and/or
two or more labelled probes (eg nucleic acid probes, such as those for qPCR), each probe for detecting one of said two or more reference DMRs (such as, one probe for detecting a DMR located in SEQ ID No.: 66 and another probe for detecting a DMR located in SEQ ID No.: 102) In particular such embodiments, two or more or such probes present in the composition are labelled with the same detectable label(s). The probes (and labels) may be for any of the reference DMRs disclosed herein, in particular those disclosed in TABLE 1 and/or TABLE 5 and/or TABLE E; and/or
two or more pairs of PCR primers, each pair for amplifying one of said two or more reference DMRs, for example for amplifying the reference DMRs for which the probes in the composition are for detecting (such as, one primer pair for amplifying a DMR located in SEQ ID No.: 66 and another primer pair for amplifying a DMR located in SEQ ID No.: 102).

In alternative or additional embodiments of such aspect, the composition may further comprise one or more of the following additional components:
at least one further pair of primers (preferably two further pairs of primers), each pair for amplifying one of said at least one OR and/or
at least one further labelled probe (preferably two further labelled probes), each probe for detecting at least one of said ORs. In particular such embodiments, two or more or such probes present in the composition are labelled with the same detectable label(s). The probes (and labels) may be for any of the ORs disclosed herein, in particular those disclosed in TABLE 1 and/or TABLE D and/or TABLE 5 and/or TABLE E.

In further alternative or additional embodiments of such aspect, the composition may further comprise one or more of the additional components for amplifying and/or detecting one, tow, there or more second target DMRs, in particular where such second target DMRs are located on a different chromosome relevant to a chromosomal aneuploidy than the first target DMRs.

A yet further additional aspect of the invention relates to a kit (for example a kit of separate components; such as a kit of holders or vessels, each holding a different component of the kit), such kit comprising a combination of primers and/or probes wherein said combination is as described in the context of any of the compositions of the present invention. For example, a kit of the present invention may contain (packaged or contained separately or in admixture) two (or more) labelled probes (eg nucleic acid probes, such as those for qPCR), each probe for detecting one of said two or more first target DMRs (such as, one probe for detecting a DMR located in SEQ ID No.: 51 and another probe for detecting a DMR located in SEQ ID No.: 185); for example where, two or more or such probes present in the kit are labelled with different detectable label(s). Additional probes and/or primers (such as those described in the context of the compositions of the present invention) optionally may be present in a kit of the present invention (such as, one primer pair for amplifying a DMR located in SEQ ID No.: 51 and another primer pair for amplifying a DMR located in SEQ ID No.: 185; and/or such as one probe for detecting a DMR located in SEQ ID No.: 66 and another probe for detecting a DMR located in SEQ ID No.: 102; and/or one primer pair for amplifying a DMR located in SEQ ID No.: 66 and another primer pair for amplifying a DMR located in SEQ ID No.: 102).

In particular embodiments, the sequence of such probes and/or primers present in the kit or composition may be modified to detect bisulphite converted DNA in a sequence specific manner; for example such sequence modified primer or probes may be used or useful for MSP or MethylLight embodiments of the inventive method.

A kit of the present invention may, be used or useful for detecting a chromosomal aneuploidy in a foetus carried by a pregnant female and/or for detecting an increased risk of a pregnant female suffering from or developing a medical condition.

In further embodiments, a kit of the present invention may comprise additional components. For example, the kit may additionally comprise: (i) a printed manual or computer readable memory comprising instructions to use said primers and/or probes to practice a method of the invention and/or to produce or use a composition of the invention; and/or (ii) one or more other item, component or reagent useful for the practice of a method of the invention and/or the production or use of a composition of the invention, including any such item, component or reagent disclosed herein useful for such practice or production. For example, the kit may further comprise the reagent that differently modifies methylated and non-methylated DNA as set above, Taq polymerase, and/or reactions buffers etc.

By way of further non-limiting example, a kit of the present invention may additionally comprise one or more of the following components:
  means to collect and/or store a tissue sample, such as blood, to be taken from said pregnant female, preferably wherein said means is a blood collection tube; and/or
  means to extract DNA, preferably cell-free DNA, from the sample to be taken from said pregnant female, preferably wherein said means is a cell-free DNA extraction kit; and/or
  a printed manual or computer readable memory comprising instructions to identify, obtain and/or use one or both of said means in the context of a method of the present invention; and/or
  a computer program product of the present invention, or instructions on how to obtain access to or generate results from such a computer program product.

In particular embodiments of the composition or the kit, one or more of the primers or probes comprised therein comprises (or consists of) a primer or probe sequence selected from one set forth in TABLE 1, TABLE D and/or TABLE 5 and/or TABLE E and/or TABLE 8 and/or TABLE 10 (optionally with the detectable label(s) described therein for such probe). In certain of such embodiments, the composition or the kit comprises the pair or primers and a probe as set forth in TABLE 5 (or, in respect of each of assay version V10.1, V10.2, V10.3, V10.4, V10.5 and V10.6, as set forth in TABLE E, in particular in respect of assay version V10.3) for each of (x) two of the first target DMRs; and (y) two of the reference DMRs, and optionally with (z) one or two of the ORs; in particular the probes for the first target DMRs are differently labelled, the probes for the two reference DMRs are labelled with the same detectable label(s) and, if present, the probes for the two ORs are labelled with the same detectable label(s).

In particular embodiments, the probes may be labelled with the label/quencher (and optionally a minor grove binding moiety) as set forth in the respective table for such probe.

In another aspect, the present invention relates to a nucleic acid, preferably a synthetic, isolated and/or purified nucleic acid, that consists (or comprises) the sequence of any of the primers or probes defined herein, or of the DMRs amplified. In particular embodiments, the primer is covalently linked to a detectable label. In particular embodiments, the sequence of such probes and/or primers may be modified to detect bisulphite converted DNA in a sequence specific manner; for example such sequence modified primer or probes may be useful for MSP or MethylLight embodiments of the inventive method.

In alternative aspects, a kit of the present invention may comprise one or more of such nucleic acids together with: (i) a printed manual or computer readable memory comprising instructions to identify, obtain and/or use said nucleic acid in the context of a method; and/or (ii) a computer program product of the present invention, or instructions on how to obtain access to or generate results from such a computer program product. Such a kit may further comprise and additional components, such as one or more other item, component or reagent useful for the practice of a method of the present invention and/or the production or use of the composition of the present invention including any such item, component or reagent disclosed herein useful for such practice or production.

Another further aspect of the invention relates to a computer program product comprising: a computer readable medium encoded with a plurality of instructions for controlling a computing system to perform and/or manage an operation for detecting a chromosomal aneuploidy in a foetus carried by a pregnant female from a sample taken from said pregnant female, which sample comprises DNA that originates from cells of a foetus and/or the placenta of a foetus in admixture with differently methylated DNA of maternal origin, the DNA present in said sample being treated with a reagent that differentially modifies methylated and non-methylated DNA such conducted in a method of the invention; said operation comprising the steps of:
  receiving: (i) two (or more) signals, each representing an amount of the first target species of DNA, being the chromosome relevant to the chromosomal aneuploidy, present in said sample such as as set forth in step (c) of the method of the present invention; and (ii) one signal representing an amount of reference species of DNA, being one or more reference chromosomes, present in said sample such as as set forth in step (d) of the method of the present invention;

determining a classification of whether a chromosomal aneuploidy is likely to be present in the foetus carried by said pregnant female based on at least one (preferable at least two) relative amount(s) of the chromosome relevant to the chromosomal aneuploidy represented by at least one signal (preferably two signals) received in (i) compared to an amount of reference chromosomes represented by the signal received in (ii), wherein at least one (preferably at least two) indicates the presence or absence of the chromosomal aneuploidy in the foetus In certain embodiments of the computer program product of the present invention, the relative amount can be calculated or otherwise generated from two (or more) of the signals received in (i). For example, a mean, median and/or a Z-Score.

In other certain embodiments of the computer program product, the signals representing said amounts of DNA determined in step (c) and step (d) may be generated using the same aliquot of DNA of said sample, and in the same vessel, and effectively simultaneously for said first target DMRs and said reference DMRs; optionally using: (x) the same detectable labels(s) for at least two (preferably each) of said reference DMRs; and (y) a different detectable label(s) for at least two (preferably each) of said first target DMRs.

The operation controlled by the computer program product may conduct such classification by making comparison to threshold(s) and/or reference distribution(s), wherein one or more (preferably two or more) of said relative amount(s) or ratio(s) higher or lower than said threshold(s) and/or reference distribution(s) indicates the presence of the chromosomal aneuploidy in the foetus. In particular, said operation computes said threshold(s) and/or reference distribution(s) from a plurality of samples each taken from a different pregnant female by receiving a plurality of signals (i) and (ii) in respect of said plurality of samples; optionally wherein said plurality of samples is analysed in one or more groups of samples by a method the present invention and wherein said method is conducted on each sample in a given group in a separate vessel, and effectively simultaneously with each other member of the plurality of samples in such group.

In certain embodiments of the computer program product, said operation further comprises one or more of the steps:

determining a classification of whether the pregnant female has an increased risk of suffering from or developing a pregnancy-associated medical condition based on comparing said amount of foetal DNA present to a threshold and/or reference distribution, wherein an increase in, or outlying of, the amount of said foetal of DNA from said threshold and/or reference distribution indicates an increased risk of the pregnant female suffering from or developing said pregnancy-associated medical condition; and/or a quality-control calculation, process or step, such as one disclosed here.

In certain embodiments, of the present invention, a quality-control calculation, process or step may be practiced prior to any determination step. In this way, those samples/analyses that do not pass the required QC criteria are not included in any further step, process or analysis.

It is to be understood that application of the teachings of the present invention to a specific problem or environment, and the inclusion of variations of the present invention or additional features thereto (such as further aspects and embodiments), will be within the capabilities of one having ordinary skill in the art in light of the teachings contained herein.

Unless context dictates otherwise, the descriptions and definitions of the features set out above are not limited to any particular aspect or embodiment of the invention and apply equally to all aspects and embodiments which are described.

All references, patents, and publications cited herein are hereby incorporated by reference in their entirety.

Certain aspects and embodiments of the invention will now be illustrated by way of example and with reference to the description, figures and tables set out herein. Such examples of the methods, uses and other aspects of the present invention are representative only, and should not be taken to limit the scope of the present invention to only such representative examples.

Example 1 (Comparative): Use of a Differential Methylation-Based DNA Detection Method in a Quantification Step Prior to MGS-Based NIPT in Multiple Pregnancies, Including in Cases of Vanishing Twins Sample Collection, Processing and DNA Extraction:

36 blood samples from women pregnant with multiple gestations (mono-, di- and trichorionic twin and triplet pregnancies) were collected between Nov. 6, 2012 and Nov. 16, 2013, for research & development (R&D) purposes and as part of routine non-invasive prenatal testing (NIPT) laboratory procedure. One blood sample came from a woman pregnant with triplets, the remaining 35 samples came from twin pregnancies. From each pregnant woman carrying a multiple pregnancy two samples each with 7-10 ml venous blood were collected using Streck cell-free DNA blood collection tubes (Streck). The blood samples were shipped to the diagnostic laboratory with a maximum delivery time of 4 days. Other blood samples from pregnant females analysed herein were similarly collected.

Plasma preparation was performed by centrifugation (1600 g for 10 min at 4° C.) and plasma separation followed by a second centrifugation step (16000 g for 10 min at 4° C.). Extraction of total cell-free DNA (cfDNA) was performed with QIAamp Circulating Nucleic Acid Kit (Qiagen) according to the manufacturer protocol using 3.0-4.0 ml plasma with a final elution volume of 60 ul AVE-buffer (Qiagen).

DNA Quantification:

Foetal cell-free DNA (foetal cfDNA) was detected and quantified in relation to total cell-free DNA (total cfDNA) in order to determine the foetal cfDNA fraction as both a relative concentration and absolute amount using a differential methylation-based DNA detection. From the eluted cell-free DNA, 11 ul were digested with the CpG-methylation sensitive enzymes HhaI (0.4 U/ul), HpaII (0.3 U/ul) and BstUI (0.3 U/ul) in a 22 ul reaction using CutSmart™ Buffer (New England Biolabs). The reaction was incubated for 60 min at 37° C. and 60 min at 60° C. 10 ul from the digestion reaction was used as template DNA for quantitative probe-based PCR (reactions were conducted in duplicate), described briefly as follows.

A 25 ul PCR reaction using a 2-fold concentrated PCR master mix (QuantiFast Multiplex PCR Kit, Qiagen) was conducted. Primers that span CpG methylation sensitive restriction enzyme sites of the respective region that is differentially methylated between foetal and maternal DNA (as a DMR) were used in combination with FAM-labelled probes for such DMRs, and primers that do not span any restriction enzyme sites, an other region that is not differentially methylated between foetal and maternal DNA (as an OR) are used in combination with VIC-labelled probes for such ORs. The sequences of the primers and labelled probes used in this example are described in TABLE 1, and the thermocycler profiles used for the quantitative probe-based (TaqMan) PCR (LightCycler 480 II Instrument; Roche) are described in TABLE 2. In this example, the probes used to detect the presence of the two DMRs, are each labelled with the same detectable fluorescein amidite (FAM) fluorescent moiety, and each with the same minor binding grove (MGB) non-fluorescent quencher (NFQ) moiety, and the probes used to detect the presence of the two ORs, are each labelled with the same detectable VIC (life Technologies) fluorescent moiety, and each with the same MGBNFQ moiety.

sensitive locus located in RASSF1A, and the methylation insensitive locus located in TBX3 is located between 10 kb and 11 kp (10.64 kb) downstream of the methylation sensitive locus located in TBX3. FIG. 2 depicts the respective arrangements and detection modalities of the two DMRs and the two other regions used in this example.

Parallel probe-based quantitative PCR reactions were performed (in separate reactions within the same PCR run) using for template a serial dilution of male genomic DNA (Promega) having known concentrations as a standard. The foetal cfDNA fraction was calculated by relative quantification of signals in the FAM channel (DMR; ie detecting foetal cfDNA) versus the VIC channel (ORs; ie detecting total cfDNA), and the absolute total cfDNA amount was calculated by absolute quantification of signals in the VIC

TABLE 1

Quantitative (probe-based) PCR components

| Region | Component | Sequence (5'-3')** | SEQ ID No.* | Stock Conc | ul for 1x | Final uM Conc |
|---|---|---|---|---|---|---|
|  | Master-mix | N/A |  | 2x | 12.5 | 1x |
| RASSF1A DMR | DMR1-For | ATT GAG CTG CGG GAG CTG GC | 1 | 100 uM | 0.35 | 1.4 |
|  | DMR1-Rev | TGC CGT GTG GGG TTG CAC | 2 | 100 uM | 0.35 | 1.4 |
|  | DMR1-Probe | [FAM]-ACC CGG CTG GAG CGT-[MGBNFQ] | 3 | 100 uM | 0.035 | 0.14 |
| RASSF1A Other region | OR1-For | GGT CAT CCA CCA CCA AGA AC | 4 | 100 uM | 0.35 | 1.4 |
|  | OR1-Rev | TGC CCA AGG ATG CTG TCA AG | 5 | 100 uM | 0.35 | 1.4 |
|  | OR1-Probe | [VIC]-GGG CCT CAA TGA CTT CAC GT-[MGBNFQ] | 6 | 100 uM | 0.035 | 0.14 |
| TBX3 DMR | DMR2-For | GGT GCG AAC TCC TCT TTG TC | 7 | 100 uM | 0.35 | 1.4 |
|  | DMR2-Rev | TTA ATC ACC CAG CGC ATG GC | 8 | 100 uM | 0.35 | 1.4 |
|  | DMR2-Probe | [FAM]-CCC TCC CGG TGG GTG ATA AA-[MGBNFQ] | 9 | 100 uM | 0.035 | 0.14 |
| TBX3 Other region | OR2-For | TGT TCA CTG GAG GAC TCA TC | 10 | 100 uM | 0.35 | 1.4 |
|  | OR2-Rev | CAG TCC ATG AGG GTG TTT G | 11 | 100 uM | 0.35 | 1.4 |
|  | OR2-Probe | [VIC]-GAG GTC CCA TTC TCC TTT-[MGBNFQ] | 12 | 100 uM | 0.035 | 0.14 |
| General reagents | DMSO | N/A |  | 100% | 0.025 | 0.625 |
|  | MgCl2 | N/A |  | 50 mM | 2 | 1 |
|  | DNA sample | N/A |  |  | 10 |  |
|  | Water |  |  |  | — |  |
|  | Total |  |  |  | 25 |  |

*Only nucleotide sequence listed, without dyes/quenchers
**The dyes/quenchers used for each probe are shown in "[]" parentheses

TABLE 2

Thermocycler profiles

| Step | Temperature | Time | Cycles | Analysis mode |
|---|---|---|---|---|
| Pre-incubation | 95° C. | 5 min | 1 | None |
| Denaturation | 95° C. | 10 sec | 45 | Quantification |
| Annealing | 60° C. | 10 sec |  | None |
| Elongation | 72° C. | 8 sec |  | Single |
| Cooling | 40° C. |  |  | None |

The differential methylation-based DNA detection assay design used in this example is based on two marker DMRs which are described to be hypomethylated in maternal DNA and hypermethylated in foetal DNA (Nygren, et al, 2010: Clin Chem 56, 1627; Chan et al, 2006: Clin Chem 42, 2211; Chiu et al, 2007: Am J Pathol 170, 941), and two other regions (ORs) not differentially methylated between maternal and foetal DNA which are each located between about 20 bp and 20 kb of their DMR. In particular, the methylation insensitive locus located in RASSF1A is located between 8 kb and 9 kb (8.97 kb) downstream of the methylation channel obtained from the sample compared to the VIC channel obtained from the dilution series of standard DNA of known concentration. Such relative and absolute quantifications were conducted using LightCycler 480 Software release 1.5.0 (Roche).

Maternal Plasma DNA Sequencing and Data Analysis to Identify Foetal Aneuploidy:

DNA sequencing libraries were prepared using NEBNext Ultra™ DNA Library Prep Kit from Illumina. Libraries were prepared according to the manufacturer protocol automated on a Hamilton STARplus robot. Library quality and quantity was measured using a Bioanalyzer instrument (Agilent) and a Qbit Fluorometer (Invitrogen). Based on the library quantification dilutions and equimolar pools of 12 samples per pool were prepared. The pooled samples were sequenced on one lane of an Illumina v3 flow cell on an Illumina HiSeq2000 sequencer. Clonal clusters were generated using TruSeq SR Cluster Kit v3-cBot-HS on a cBot Cluster generation System according to the manufacturer protocol. Bioinformatic analysis to identify foetal chromosomal aneuploidy was carried out as described previously, with z-scores≥3 indicating the presence of a foetal trisomy 21 (Stumm et al 2014, Prenat Diag 34:185). In cases of a positive test result for foetal aneuploidy from this NGS-based method, the result was confirmed by invasive diagnostic methods.

Results:

Characteristics, % foetal fraction of cfDNA determined by the method of the present example and aneuploidy test results determined by such NGS-based method for the blood samples are given in TABLE 3. There were two positive NGS-based test results indicating foetal trisomy 21. Both were confirmed by karyotyping after amniocentesis; thus, the false positive rate in this NGS-based study was 0%. One blood sample represented monochorionic twins with concordant karyotypes [47,XY,+21] and the other one represented dichorionic twins with discordant karyotypes [47, XY,+21 and 46XX]. In both samples the foetal fraction was as high as 18.0 and 24.8%, respectively. All other NGS-based NIPT results were negative for trisomies 21, 18 and 13. There is no evidence for false-negative NIPT results so far in the pregnancies included in this study.

Prenat Diag 33:675; Qu et al 2007, Am J Pathol 170:941; Struble et al 2013, Fetal Diagn Ther December 7 Epub ahead of print). This is especially important for dichorionic twin pregnancies with discordant karyotypes. In the study described above, supporting information was used for the definition of the minimum foetal cfDNA fraction for twin pregnancies derived from the Y-chromosomal representation, if only one of the two foetuses is male. Using the method of the present example, the total foetal cfDNA fraction can be determined, which reflects the summary of foetal cfDNA derived from both foetuses. Using the Y-chromosomal representation from the next generation sequencing, the foetal cfDNA amount can be determined for male foetuses (as described in Stumm et al 2014). Thus, in the case of mixed foetal gender the contributing amount of each foetus can be determined by subtraction of the amount of foetal cfDNA determined by the Y-chromosomal representation from the foetal cfDNA fraction measured by method of the present example. The foetal cfDNA fractions determined by the method of the present example were compared with the values obtained from Y-chromosomal reads from next generation sequencing for cases with known gender (see FIG. 3). There is a correlation of the amount of male specific cfDNA (y axis) to the foetal cfDNA fraction measured by method of the present example (x axis). Thus, for twin pregnancies with male/male gender approximately true is: [y=x], for female/male genders it is: [y=0.5x] and for female/female: [y=1]. The genders of cases with similar

TABLE 3

Characteristics and NIPT results for the collected blood samples

| Sample | Chr13 z-score | Chr18 z-score | Chr21 z-score | Foetal DNA fraction (%) | Gestational age (p.m.) | No. of foetuses, chorinicity amnionicity | NIPT result |
|---|---|---|---|---|---|---|---|
| LCMPC05 | 1.3 | −1.0 | −0.8 | 16.7 | 11 + 5 | 3, trichorionic, triamniotic | negative |
| LCMPC06 | −0.4 | 1.1 | 8.5 | 18.0 | 13 + 2 | 2, monochorionic, n.a. | T21 positive |
| LCMPC07 | −1.0 | 0.3 | 0.9 | 7.9 | 19 + 0 | 2, dichorionic, diamniotic | negative |
| LCMPC08 | 0.7 | 1.2 | 0.0 | 16.5 | 18 + 1 | 2, dichorionic, diamniotic | negative |
| LCMPC09 | 0.6 | −0.8 | 0.7 | 8.9 | 11 + 5 | 2, monochorionic, diamniotic | negative |
| LCMPC10 | 0.3 | 0.7 | −0.7 | 17.6 | 20 + 4 | 2, dichorionic, diamniotic | negative |
| LCMPC11 | −0.9 | −0.8 | 0.7 | 11.5 | 23 + 0 | 2, dichorionic, diamniotic | negative |
| LCMPC12 | −0.9 | −0.7 | −2.0 | 13.3 | 11 + 1 | 2, monochorionic, diamniotic | negative |
| LCMPC13 | 1.3 | 0.1 | 0.3 | 21.4 | 16 + 0 | 2, dichorionic, diamniotic | negative |
| LCMPC14 | 0.2 | −0.3 | 0.0 | 6.8 | 12 + 5 | 2, n.a., n.a. | negative |
| LCMPC15 | 2.2 | 0.1 | 14.7 | 24.8 | 16 + 0 | 2, dichorionic, diamniotic | T21 positive |
| LCMPC16 | 1.1 | 1.7 | 0.5 | 5.4 | 12 + 5 | 2, n.a., n.a. | negative |
| LCMPC17 | 0.7 | 1.4 | 0.5 | 16.5 | 14 + 2 | 2, n.a., n.a. | negative |
| LCMPC18 | 0.3 | 2.6 | 0.0 | 18.5 | 18 + 3 | 2, n.a., n.a. | negative |
| LCMPC19 | −0.2 | 0.8 | 0.3 | 16.6 | 14 + 0 | 2, dichorionic, diamniotic | negative |
| LCMPC20 | −0.7 | −0.9 | 0.1 | 13.1 | 15 + 4 | 2, dichorionic, diamniotic | negative |
| LCMPC21 | 1.0 | −0.7 | 1.2 | 8.4 | 9 + 3 | 2, dichorionic, diamniotic | negative |
| LCMPC22 | −1.1 | −0.2 | 0.3 | 5.6 | 16 + 2 | 2, monochorionic, n.a. | negative |
| LCMPC23 | −2.2 | 2.2 | −0.8 | 20.6 | 19 + 5 | 2, monochorionic, n.a. | negative |
| LCMPC24 | −1.6 | −0.4 | −0.5 | 14.7 | 22 + 2 | 2, monochorionic, diamniotic | negative |
| LCMPC25 | −0.8 | −0.2 | −1.5 | 12.1 | 11 + 5 | 2, n.a., n.a. | negative |
| LCMPC26 | −0.4 | −0.6 | −1.3 | 7.5 | 13 + 0 | 2, dichorionic, diamniotic | negative |
| LCMPC27 | 0.5 | −0.8 | −0.4 | 16.3 | 12 + 6 | 2, n.a., n.a. | negative |
| LCMPC28 | −1.2 | −0.3 | −0.7 | 19.4 | 10 + 1 | 2, dichorionic, diamniotic | negative |
| LCMPC29 | −0.8 | 0.7 | −0.4 | 14.2 | 13 + 2 | 2, monochorionic, n.a. | negative |
| LCMPC30 | 0.7 | 0.3 | 0.9 | 14.9 | 12 + 2 | 2, monochorionic, monoamniotic | negative |
| LCMPC31 | −0.2 | 0.3 | −0.9 | 19.3 | 19 + 1 | 2, dichorionic, diamniotic | negative |
| LCMPC32 | −1.1 | 2.5 | −2.2 | 11.6 | 20 + 0 | 2, dichorionic, diamniotic | negative |
| LCMPC33 | 0.2 | 2.2 | −1.6 | 8.6 | 11 + 0 | 2, dichorionic, diamniotic | negative |
| LCMPC34 | −1.0 | 1.2 | 0.0 | 15.1 | 15 + 4 | 2, dichorionic, diamniotic | negative |
| LCMPC35 | −0.3 | −0.8 | −0.3 | 19.2 | 12 + 0 | 2, dichorionic, diamniotic | negative |
| LCMPC36 | −1.4 | −0.5 | −0.8 | 13.9 | 12 + 0 | 2, dichorionic, diamniotic | negative |
| LCMPC37 | 1.8 | −0.7 | 0.1 | 13.8 | 17 + 6 | 2, dichorionic, diamniotic | negative |
| LCMPC38 | −0.1 | 1.1 | −0.7 | 13.4 | 13 + 1 | 2, dichorionic, diamniotic | negative |
| LCMPC39 | −1.9 | 0.2 | −2.2 | 15.0 | 17 + 0 | 2, dichorionic, diamniotic | negative |
| LCMPC40 | 0.6 | −0.4 | 0.8 | 16.2 | 18 + 3 | 2, dichorionic, diamniotic | negative |

Figure 3:
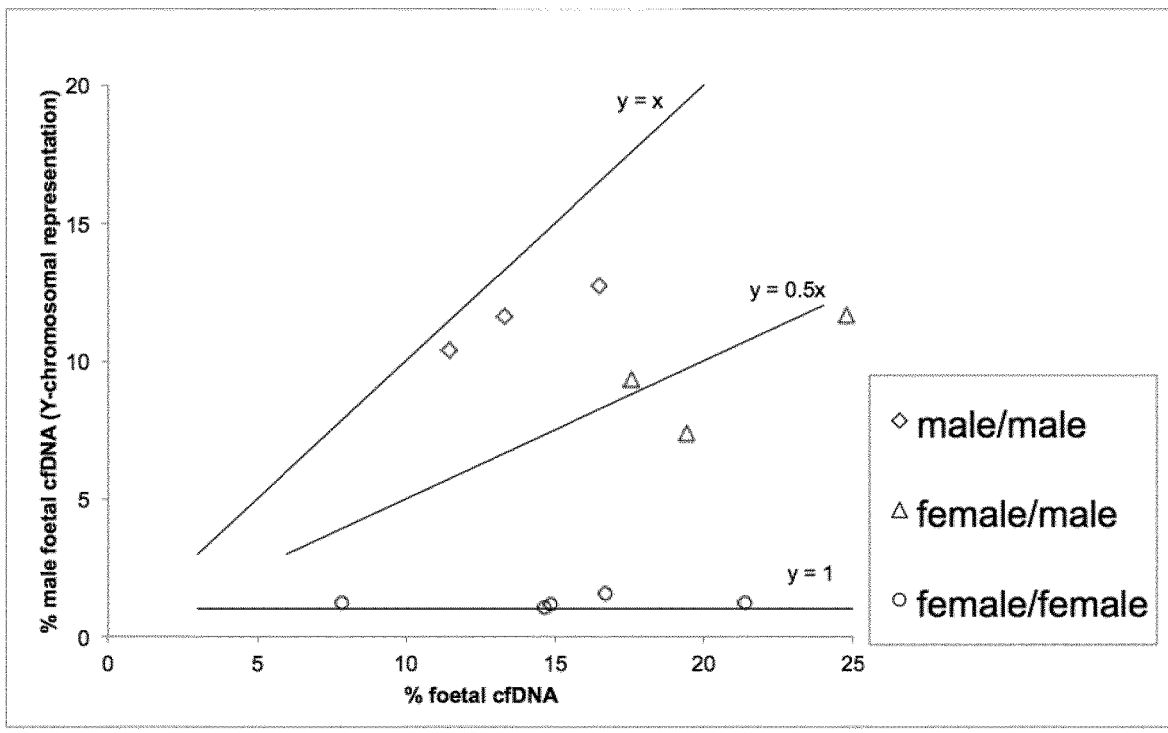
FIG. 3 depicts the correlation of the amount of male specific DNA (Y chromosomal-representation) to the foetal cfDNA fraction measured by a differential methylation-based DNA detection method (Example 1) for study twin cases with known foetal genders.

The reliable detection of foetal aneuploidy in twin pregnancies by prior art NGS-based NIPT is dependent on a sufficiently high amount of foetal cfDNA from each foetus in the maternal blood. Different data and considerations have been published on how the lower limit of foetal cfDNA fraction should be defined to ensure that each twin's contribution is above the detection threshold (Leung et al 2013, values are male/male and in case of differing values with low Y-chromosomal representation the genders are female/female. The intermediate cases, which show about half the percentage of foetal fraction as Y-chromosomal representation, are of mixed gender. The data presented in FIG. 3 show that it is not only possible to determine the foetal genders using prior art NGS-based NIPT results for twin pregnancies, but also that the measurement of the amount of foetal fraction of cfDNA determined by the method of the present example is accurate as compared to frequency counting of Y chromosome sequences. On the other hand, these data support the hypothesis that each foetus of a twin pregnancy contributes roughly about half of the total foetal cfDNA fraction. This leads to the conclusion that for twin pregnancies, twice the amount of foetal cfDNA would be required, and thus a recommended minimum foetal fraction of cfDNA for prior art NGS-based NIPT of a twin pregnancy could be considered to be 8%.

For monochorionic twin pregnancies with concordant genotypes (apart from rare exceptions, Chen et al 2013, Am J Med Genet A 161A:1817), a foetal cfDNA fraction of 4% would be enough to detect a foetal aneuploidy, just as for single pregnancies. However, for routine laboratory NIPT service one major issue speaks against the implication of such different quality criteria for mono- and dichorionic pregnancies: the determination of chorionicity is dependent on the gestational age and the practical experience of the physician performing the ultrasound examination. The chorionicity is clearly detectable in the first trimester of a multiple pregnancy, but in later stages detection becomes more difficult (Sperling et al 2001, Acta Obstet Gynecol Scand 80:287). Therefore, it is a safer strategy to generally define a minimum foetal cfDNA fraction for twin pregnancies, which is applicable for monochorionic as well as for dichorionic multiple pregnancies.

Identification of Vanishing Twins:

In two cases of NIPT aneuploidy testing in which the foetal cfDNA fraction was measured using the method of the present example, identified a trisomy 21 (z-scores 13.5 and 3.4 respectively), but also a striking discrepancy between the total foetal cfDNA fraction measured by the method of the present example and the cf-Foetal-DNA amount measured by Y-chromosome representation were observed.

For case A, two analyses of blood samples (first and back-up samples) estimated the total foetal cfDNA fraction measured the method of the present example was 20.7% and 24.8%, respectively, whereas the foetal cfDNA according to the Y-chromosomal representation from next generation sequencing was 9.2% and 9.3%, respectively. It was speculated, and reported to the physician, that the pregnancy may be a mixed-sex twin pregnancy, who confirmed that a deceased twin had been observed during ultrasound scan at week 10. A further blood sample taken in the third trimester of the pregnancy (38+2) turned out to be negative for trisomy 21 and the foetal cfDNA amount measured by Y-chromosomal representation correlated with the foetal amount measured by QuantYfeX (21.7% and 21.4), which matched the male gender determined by karyotyping of the living foetus. At birth a foetus papyraceus was found in the placental tissue from which a sufficient amount of cells could be isolated for cell culture and following GTG banding, a trisomy 21 positive, female karyotype was confirmed (47,XX,+21).

For case B, a slightly increased Y-chromosomal representation was monitored indicating male specific cf-Foetal-DNA of 3.0% and 2.7% respectively. As the foetal cfDNA fraction estimates measured by the method of the present example were far above that (13.4% and 10.0%) we hypothesized from this discrepancy in the foetal fraction measured, that two foetuses with discordant gender contribute to the foetal fraction and the male foetus being the one affected by trisomy 21. This suggestion was derived from the correlation of Y-chromosome specific foetal cfDNA amount of roughly 3% with the elevated z-score around the cut-off value of 3.0. Since the examination was clearly requested for a singleton pregnancy, the male specific foetal cfDNA was suspected to stem from a vanishing twin—maybe the carrier of a trisomy 21—that was either not recognized or not indicated on the consent form for NIPT. Thus, the result was reported to be indecisive for chromosome 21 and the conflicting data was reported to the responsible physician, including a notice regarding the potential vanishing twin, for further clarification via ultrasound. The responsible physician subsequently confirmed that the pregnancy had started as twin and later continued as a singleton pregnancy. The gender of the living and apparently healthy foetus was confirmed to be female and thus, the foetal cfDNA that caused the increased z-score for trisomy 21 can clearly be assigned to a deceased male foetus.

Example 2 (Comparative): Improved Detection Sensitivity of Reference Chromosomes Using Two Differentially Methylated Regions Using the Same Detectable Moiety/Moieties for Each Differentially Methylated Region The inventors observe that a complex and multiplex reaction detecting two DMRs using the same detectable moiety/moieties for each of said DMR (as well as two other regions (OR) not differentially methylated) was more sensitive to detect foetal derived reference chromosomes than previous detection reactions that each detected—in separate PCR reactions—a single DMR (as well as a single OR) (FIG. 4).

In another differential methylation-based DNA detection method, two DMRs (those found in RASSF1A and TBX3, as described in Example 1), and located on human chromosomes 3 and 12 respectively, were detected (over 4 dilutions) with the same aliquot of DNA and reaction—effectively simultaneously (using quantitative probe-based (TaqMan) PCR)—also with two ORs (those found in RASSF1A and TBX3, as described in Example 1), using the same detectable moiety/moieties for each of said DMR (and a detectable moiety/moieties for said at least one OR that is/are different to the detectable moiety/moieties used for said DMRs). In comparison, detection of foetal derived reference chromosomes in cfDNA was less sensitive, as shown by detection at higher cycle numbers (Cp), if each DMR (and corresponding OR) was detected independently in separate reactions. The regions/markers, primers/probes and detection methodology was substantially as described in Example 1, except that for the single locus reactions, only the DMR (and corresponding OR) from a given gene (RASSF1A or TBX3) were detected simultaneously in a single reaction.

In contrast, detection of foetal derived reference chromosomes in cfDNA using a multiplex reaction of the two DMRs using different detectable moieties (eg FAM for the RASSF1A locus and VIC for the TBX3 locus) is determined to be even less sensitive (and further is difficult to detect simultaneously with any OR); without being bound by theory, believed due to the higher complexity of colour compensation, the limited number of separately detectable fluorescent markers and/or the "bleaching" effects from so many fluorescent markers being present in the same reaction.

Given the exponential nature of quantitative PCR detection, a higher sensitivity of detection (ie lower cycle numbers) would also equate to higher accuracy of quantification, as the correction to standard curves, and interpolation between data points, would be subject to less error than that arising with the amounts of DNA (ie of quantification of the reference chromosomes) correlating to detection at higher cycle numbers.

Example 3 (Comparative): Use of a Differential Methylation-Based DNA Quantification Method for the Detection of an Increased Risk of a Pregnant Woman Suffering from or Developing Preeclampsia (Prophetic Example)

Using a method of a comparative example, pregnant women are assessed for their risk of suffering from or developing preeclampsia as follows. Firstly, a blood sample is collected from the woman for whom such risk to be assessed and total cfDNA extracted from the plasma of such sample substantially in accordance with the procedures described in Example 1. Secondly, using a method substantially as described in Example 1, a relative and/or absolute amount of foetal cfDNA and total cfDNA present in the plasma is determined, where the absolute amount of foetal and/or total cfDNA can be expressed as the amount of genome equivalents ("Eq"). Thirdly, such determined amount of cfDNA and/or total cfDNA is compared to a threshold amount or a reference distribution of amounts, and the women is determined to be at increased risk of suffering from or developing preeclampsia if the amount of foetal cfDNA or total cfDNA exceeds such threshold value and/or is an outlier in such distribution.

For example, using published threshold values (Papantoniou et al 2013, Prenat Diag 33:682) if the total cfDNA exceeds an amount of about 7,500 Eg/mL plasma or if the foetal cfDNA fraction exceeds an amount of about 500 Eg/mL plasma, then the woman is determined to have such an increased risk. Such a risk may instead or additional be assessed by considering: (i) the fold-increase (eg 1.5, 3, 3.5 or 4-fold increase) of foetal cfDNA (determined for such woman compared to a threshold amount), factoring into the determination that for later-term pregnancies a higher fold-increase in foetal cfDNA may be utilised (Zeybek et al 2013, J Obstet Gynaecol Res 39:632); and/or (ii) into which percentile the amount of cfDNA determined from the woman falls, from consideration of a reference distribution of amounts determined from low-risk women or women who did not suffer from or develop preeclampsia, for example if the foetal cfDNA fraction falls within the 90$^{th}$ percentile of such a distribution, then the woman is considered to have an increased risk of suffering mild or severe preeclampsia (Jakobsen et al 2013, Transfusion 53:1956).

In this example, the detection of a risk is conducted using a computer program product that performs the operations represented by FIG. 5. Operation (A) receives signals (1) and (2) representing, respectively, foetal and total cfDNA are used by the computer program product to determine a parameter (4) that represents the relative and/or absolute amount of foetal (or total) cfDNA present in the plasma of the woman. This operation may optional receive a signal (3) representing an absolute amount of standard DNA. A second operation (B) compares such determined parameter (4) against a threshold amount (5) and/or a reference population of amounts (6) so as to determine and report (7) whether or not—and based on such comparison—the woman is determined to be at increase risk of suffering or developing preeclampsia.

Example 4: Use of a Method of the Invention as a Direct and Efficient Method for NIPT to Detect Trisomy 21

The present invention was able to identify cfDNA samples obtained from pregnant females that were carrying a trisomy 21 foetus.

In a single multiplex PCR reaction of a method of the present invention, the amount of the foetal chromosomal 21 DNA species present in cfDNA samples obtained from 58 pregnant human females was determined at each of two target DMRs, and the amount of foetal chromosomes 5 and 12 (as reference chromosomes) reference DNA species present in the cfDNA sample was determined by use of two reference DMRs (see FIG. 6), and in respect of each pregnant female. The relative amounts of the foetal chromosomal 21 species (as estimated at each of the two target DMRs) and such foetal chromosomal reference species (as estimated by both of the two reference DMRs) was calculated as a ratio, and each ratio used to plot a scatter plot displaying the sample-specific mean (n=6 replicates) of each of the two ratios for each pregnant human females (FIG. 7). This scatter plot shows that the three "+" points, each representing a sample obtained from a pregnant female known to carry a foetus with trisomy 21 ("T21"), can be easily recognised as outliers. This scatter plot also demonstrates one advantageous feature of the inventive method, in that one non-T21 sample was observed as an outlier for one, but not the other, target DMR on chromosome 21. Only by the use of an method and analysis that can analyse at least two of such markers, such as the present inventive method, would have correctly identified this sample as an outlier from the non-T21 population rather than as a T21 sample. For example, if only the target DMR represent by the X axis had been considered, or if the average of both target DMRs had be consider (ie, both target DMRS considered together), then such a sample would have been falsely identified as being a T21 sample.

The data shown in FIG. 7 was generated from all 58 samples taken from 58 pregnant human females in a single qPCR run. However, an additional 110 samples taken from 110 pregnant human females were subsequently analysed by the same inventive method in two further qPCR runs, each run analysing samples from 54 and 56 pregnant human females, respectively. By normalisation of the data generated from the three separate runs, the total of all 168 samples could be visualised in a single scatter plot (FIG. 8). Separation of the cluster of all nine T21 samples from the non-T21 samples is clearly seen; for example as demarcated by the curved boundary shown (dotted). Normalisation between runs was made by subtracting the median value of the applicable ratio across all replicates from a single run as follows from the mean of each ratio for each sample. The resulting normalised values were plotted using a logarithmic scale after conversion to positive values by adding two.

The robustness of the method of the invention to analysis numerous samples (in this example 168) across multiple runs (in this example 3) is demonstrated (FIG. 9) by considering the run-independent separation, for each of runs 1 to 3, of the, in total, nine T21 samples (in this figure represented by "o") from the non-T21 samples (in this figure represented by "+"), of the distance of each point from FIG. 8 (by run) from the centre point of the curved demarcation line (in this example, 0.5,0.55). All nine samples were successfully classified with no false negative or false positive result.

The amount of a foetal chromosomal 21 DNA species was determined by using two target DMRs: (i) a first such DMR being located in the DSCAM gene (Down Syndrome Cell Adhesion Molecule; NCBI Reference Sequence *Homo sapiens* chromosome 21, GRCh38.p2 Primary Assembly: NC_000021.9 GI:568815577, region 40010999 to 40847113; SEQ ID No.: 200) located on human chromosome 21q22.2; and (ii) a second DMR located within about 250 bp upstream/downstream of C21orf57 (YBEY; Chromosome 21: 46,286,337-46,297,751 forward strand, GRCh38:CM000683.2; such gene including 250 bp upstream/downstream flaking regions SEQ ID No.: 218 located on human chromosome 21q22.3.

The amount of a foetal reference chromosomal DNA species was determined by using two reference DMRs: (i) a first such DMR present in the TBX3 gene (as described above) located on human chromosome 12q24.21; and (ii) a second such DMR present in the PCDHGA1 gene (protocadherin gamma subfamily A, 1; NCBI Reference Sequence *Homo sapiens* chromosome 5, GRCh38.p2 Primary Assembly: NC_000005.10 GI, region 141,330,571 to 141,512,981; SEQ ID No.: 217) located on chromosome 5q31.3. Also amplified in each multiple reaction was a first OR located about 10 Kb from the DMR in TBX3 (see above) and a second OR located about 300 bp from the DMR in PCDHGA1. The sequences of the respective DMRs (and ORs) used are described in TABLE 4.

TABLE 4

Chromosome 21, chromosome 5 and chromosome 12 DMRs and ORs

| Chr. | Chr. location | Gene/ Region | Type | Sequence (5'-3') | SEQ ID No. |
|---|---|---|---|---|---|
| 21 | 40841691- 40841781 | DSCAM | DMR | ATTGGAAGGTCAgCCAATCAGGCGCGGAGCTGCTCCC GG(t)AGCTGCCACCTCCGAGGCGCGCGCCACGCCGG GGTTCCcTcGCGGCTTTGGA | 201 |
| 21 | 46297794- 46297886 | C21orf57 | DMR | CGAGCCGTGGCATCGAGAGGGCGTCTGGAGTTCAGGGA ACGCGTGGCCCCCGCCCGGGAGCACCGCGCAGCGCTCG CCTCTCGCCCTTCAAGG | 219 |
| 12 | 114687093- 114687191 | TBX3 | DMR | AAGGTGCGAACTCCTCTTTGTCTCTGCGTGcCCGGCG CGCCCCCCTCCcgGTGGGTGATAAAcCCACTCTGGCG CCGGcCATGCGcTGGgTGATTAATT | 203 |
| 12 | 114676384- 114676454 | TBX3 | OR | TGTTcACTGGAGGACTCATCAGAGGTCCCATTCTCCT TTTTGTGTCTTTCATCAAACACCCTCAtGGACTG | 204 |
| 5 | 141492593- 141492687 | PCDHGA1 | DMR | AGCGACTGCCGCTCTAAGTGCCGGGCGGGCAGGACTCT ACGATCCTTGGGCCAGAGGTCCGGATGGTCCCGGGACT CCGTCTCAAGGGTCGGCGA | 220 |
| 5 | 141492918- 141493009 | PCDHGA1 | OR | GCGATCTAGGGTCAGAGATTTGGAGGTGACCAAACTAT CTGACACTCTAACAAGTCCTGTCTCCTCTGGCAGATGG AAAGCTATAGGCTCTG | 221 |

Methylation sensitive sites are underlined and locations of known SNPs are shown by non-capitalisation cfDNA samples from 168 pregnant human females (including 9 of which were known to carry a foetus with T21 were collected, prepared and digested with the CpG-methylation sensitive enzymes HhaI, HpaI and BstUI as described in EXAMPLE 1. A multiplex quantitative probe-based PCR reaction of the four separate loci described in TABLE 4 was conducted on replicates (n=6) of each such sample as described in EXAMPLE 1, except that the PCR buffer used was PerfeCTa MultiPlex qPCR ToughMix (Quanta BioSciences), using the PCR primers and labelled probes (with quenchers) as set forth in TABLE 5 and splitting the samples across three runs of 58, 54 and 56 samples respectively—each run consisting of such an inventive assay conducted in a single 384-well microtiter plate (Roche) with a LightCycler 48011 (Roche).

for the purposes as described in EXAMPLES 6 and/or 7, and/or as a possible or additional quality control measure (eg EXAMPLE 6), or for the purposes of other diagnosis such as described in EXAMPLE 7. As will be observed from TABLE 5, the probe for the chromosome 21 target DMR located in the DSCAM is labelled differently from the probe for the chromosome 21 target DMR located within about 250 bp upstream/downstream of C21orf57; also the reference chromosome 12 reference DMR located in TBX3 and that on chromosome 5 located in PCDHGA1 are labelled with the same label (different from the target DMRs). Finally, if required for an estimation of total DNA, the two ORs are both labelled with the same label, which too is different from the other labels used in the multiplex assay. Overall, 4 labels are used, which enables the amount of

TABLE 5

Primer and probes

| Chr. | Gene/Region | Component | Sequence (5'-3')** | SEQ ID No.* |
|---|---|---|---|---|
| 21 | DSCAM DMR | Chr21DMR1-For | ATTGGAAGGTCAGCCAATCAGG | 205 |
|  |  | Chr21DMR1-Rev | TCCAAAGCCGCGAGGGAAC | 206 |
|  |  | Chr21DMR1-Probe | [LCCyan500]-CGCCTCGGAGGTGGCAGCTC-[BHQ1] | 207 |
| 21 | C21orf57 DMR | Chr21DMR2-For | CGAGCCGTGGCATCGA | 222 |
|  |  | Chr21DMR2-Rev | CCTTGAAGGGCGAGAGG | 223 |
|  |  | Chr21DMR2-Probe | [Cy5]-CGTTCCCTGAACTCCAGACGC-[BHQ3] | 224 |
| 12 | TBX3 DMR | Chr12DMR-For | AAGGTGCGAACTCCTCTTTGTC | 211 |
|  |  | Chr12DMR-Rev | AATTAATCACCCAGCGCATGGC | 212 |
|  |  | Chr12DMR-Probe | [6FAM]-CCCCTCCCGGTGGGTGATAAACC-[Eclipse] | 213 |
| 12 | TBX3 OR | Chr12OR-For | TGTTCACTGGAGGACTCATC | 214 |
|  |  | Chr12OR-Rev | CAGTCCATGAGGGTGTTTG | 215 |
|  |  | Chr12OR-Probe | [LCRed610]-AGGTCCCATTCTCCTTTTTGTGTCTTTC-[BBQ650] | 216 |
| 5 | PCDHGA1 DMR | Chr5DMR-For | AGCGACTGCCGCTCTAA | 225 |
|  |  | Chr5DMR-Rev | TCGCCGACCCTTGAGAC | 226 |
|  |  | Chr5DMR-Probe | [6FAM]-TCTGGCCCAAGGATCGTAGAGTCC-[Eclipse] | 227 |
| 5 | PCDHGA1 OR | Chr5OR-For | GCGATCTAGGGTCAGAGATTTG | 228 |
|  |  | Chr5OR-Rev | CAGAGCCTATAGCTTTCCATCTG | 229 |
|  |  | Chr5OR-Probe | [LCRed610]-ACACTCTAACAAGTCCTGTCTCCTCTGG-[BBQ650] | 230 |

*Only nucleotide sequence listed, without dyes/quenchers
**The dyes/quenchers used for each probe are shown in "[ ]" parentheses The format of such assay is generally as depicted in FIG. 6, where the DMR1 of such figure is located in the DSCAM gene of human chromosome 21, DMR2 of such figure is located within about 250 bp upstream/downstream of the C21orf57 gene of human chromosome 21, the DMR1' of such figure is located in the TBX3 gene of human chromosome 12 and the DMR2' of such figure is located in the PCDHGA1 gene of human chromosome 5. For the purposes of calculating a relative amount of, or ratio between, the target DMRs on chromosome 21 and the reference DMRs on chromosomes 5 and 12 the ORs are not required as if used to calculate a foetal fraction of the respective chromosome, such value would be cancelled in the mathematical formulae. Hence, the amount of total DNA that may be estimated from use of the ORs is not required to analysis the T21-status of the foetus, but may still be utilised to calculate the fraction of foetal cfDNA from the total DNA; for example chromosome 21 to be independently estimated for each target DMR and the amount of reference chromosomes to be more sensitively detected (see EXAMPLE 2), for example by reference to the respective signals for each DMR (or OR) from the sample compared to signals for the respective DMR (or OR) obtained from the dilution series of standard DNA of known concentration (as described in EXAMPLE 1) as may be provided in each qPCR plate (run) as the test samples. Such relative and absolute quantifications were conducted using LightCycler 480 Software release 1.5.0 (Roche). The mean [n=6 replicates] sample-specific ratio of each % foetal cfDNA of chromosome 21 target DNA+ species and the % foetal cfDNA of both reference chromosome reference DNA species was calculated for each sample, and for each plate the overall median of all replicates was calculated. Analysis was as described above.

Example 5: Iterative z-Score Analysis to Detect Trisomy 21 in NIPT without Reference to Known Internal Euploid Standards By the application of an iterative z-score approach, the inventors were able to identify all known Trisomy 21 samples from the test samples without reference to the known euploid samples in the estimation of mean and standard deviations in the z-score analysis.

The data from each run (qPCR plate) of samples analysed in EXAMPLE 4 was re-analysed as follows. Firstly, the mean ratio of each chromosome 21 target DMR to the reference chromosomes DMRs of each replicate of the samples (n=6) was calculated, and for all samples present in such run (plate) an overall mean and standard deviation for each ratio was calculated without reference to whether a sample was known to be euploid or trisomy. Secondly, based on such run-specific means and standard deviation, (run specific) separate z-scores for each ratio associated with each target DMR for each sample present in the run were calculated. Thirdly, for each DMR, such ratios were checked for those equal or exceeding 1.95, and any such samples represented by such outlying z-scores were, independently for each of the two target DMRs, excluded from the respective reference set samples used for any subsequent determination of z-score calculation factors (run specific mean ratio and standard deviation. A second mean and standard deviation for each ratio was calculated, independently for each target DMR, on the data in respect of the remaining samples in the reference data set and used to conduct a second z-score analysis of each ratio for all samples in such set. Fourthly, the resulting z-scores (ie, those calculated after the first iterative elimination) are checked for outliers, independently for each target DMR, as in the third step, as above and those samples associated with a z-score equal or greater to 1.95 are excluded from the reference data set used to calculate z-scores in respect of each DMR. A third mean and standard deviation was then calculated, independently for each target DMR, for each ratio on the data in respect of the remaining samples in the respective reference data set and used to conduct a third z-score analysis for each ratio of all samples in such set. This iterative process was repeated for 20 times and no sample which was once excluded from the respective DMR reference set was re-included in a reference data set, even if the respective sample's z-score would again change to below 1.95 after one iterative elimination. The resulting sample z-scores for each ratio and sample are shown in FIG. 10, which displays complete separation of the euploid and T21 samples (represented by z-scores greater than about 3.0 for each of the two ratios; and/or by the mean of the two z-scores being greater than about 3.0; and/or by a cluster or distance approach analogous to that described in EXAMPLE 4/FIG. 9). Diploid outliers which obtain values above mean z-scores of 3 were excluded by defining a rule: discordant results (Marker 1 and 2) are controlled for the extent of difference. If the difference was above 4.0 they were non positive/non reportable.

Example 6: Use of a Method of the Invention to Estimate the Foetal CFDNA Fraction The % fraction of foetal DNA in the total cfDNA isolated from the pregnant female was estimated by calculating the ratio of the amount of DNA measured using the two (commonly-labelled) reference DMRs present on the two reference chromosomes and the two (commonly-labelled) ORs; each within the same gene as their respective DMR. Information on the foetal fraction of cfDNA can be used for quality control purposes, including to determine if sufficient foetal DNA is present in the sample to permit subsequent analyse such as NGS-based analysis as described in EXAMPLE 1.

Example 7: Use of a Method of the Invention to Detect an Increased Risk of a Pregnant Woman Suffering from or Developing Preeclampsia (Prophetic Example)

In addition to determining whether a foetus carried by a pregnant female is aneuploid, the format of the inventive assay described in EXAMPLE 4 (ie, one carrying at least on OR to measure total DNA) is used to also determine if the pregnant female is at risk of suffering from or developing preeclampsia as follows.

Using a method substantially as described in EXAMPLE 4, a relative and/or absolute amount of foetal cfDNA and total cfDNA present in the plasma is determined, where the absolute amount of foetal and/or total cfDNA can be expressed as the amount of genome equivalents ("Eq"). Thirdly, such determined amount of cfDNA and/or total cfDNA is compared to a threshold amount or a reference distribution of amounts, and the women is determined to be at increased risk of suffering from or developing preeclampsia if the amount of foetal cfDNA or total cfDNA exceeds such threshold value and/or is an outlier in such distribution. Published values, and other ways of assessing such a risk include those described in EXAMPLE 3. Such a method of the present invention may be used to generate signals to utilise the computer program product described in EXAMPLE 3 (and represented by FIG. 5) to detect such risk.

Example 8: Preparation and Distribution of a Kit of the Present Invention (Prophetic Example)

A kit of the present invention is prepared by forming a buffered solution for each of the primers and probes listed in TABLE 5. An aliquot of each buffered solution (eg, 200 ul) is placed in separate eppendorf tubes, and such tubes packaged in a cardboard container.

In an alternative kit, a single buffered solution is prepared that comprises an admixture of each of the primers and probes listed in TABLE 5.

In a further alternative kit, the cardboard container further includes an aliquot of the probes used to detect the two first target DRMs set forth in TABLE 5.

The cardboard container of the kit further contains a printed instruction manual, instructing the user to use the components therein (together with other components) to practice the method of the present invention to seek to detect a chromosomal aneuploidy in a foetus.

Example 9: Trial with Collected Samples (Prophetic Example)

A number of samples collected from numerous pregnant females known to carry an aneuploid or euploid foetus are analysed by a method of the present invention (such as by using an assay as described in EXAMPLE 4), but in a blinded fashion (ie, the investigators do not know which sample is from which class of pregnant female) to seek to (eg correctly) identify those samples believed to carry foeti having a chromosomal aneuploidy (eg trisomy 21). After the analysis has been conducted, the samples are un-blinded (ie, whether they did indeed carry a trisomy foetus, such as determined by NGS and/or other tests), and such information is compared to generate estimates or measures of sensitivity and specificity for the method of the present invention.

Example 10: Other Embodiments of a Direct and Efficient Method of the Invention for NIPT to Detect Trisomy 21

The utility of a method of the invention using a specific combination of DMRs, ORs and fluorescent labels/quenchers is demonstrated in EXAMPLE 4. However, the inventors have demonstrated that such a method is not limited to such specific combination as other combinations of DMRs, ORs and/or fluorescent labels/quenchers also show that such method of the invention can directly and efficiently detect trisomy 21 by NIPT. TABLE 6 shows the various permutations and/or combinations used to conduct such demonstration.

samples from pregnancies known to have been a Trisomy 21 foetus (previously determined and confirmed by a commercially available next generation sequencing-based NIPT method: PRENATEST®, LifeCodexx AG, Constance, Germany).

The method as described in EXAMPLE 4 was performed on each qPCR test run, and the data from each run were analysed and the DMR ratios calculated, corrected and presented analogously to that shown by FIG. 8; except that for the various assays embodiments tested in EXAMPLE 10, different permutations of the labels (and corresponding quencher) were used, and in two cases the second Chr 21 DMR was used. For each respective assay DMR/OR were used as shown in TABLE 6. For the assay described in the second column, the same combination of primer sequences, probes sequences and probe-labels/quenchers are as used in EXAMPLE 4, and as described in TABLE 5. For the assays described as V10.1 to V10.4, the same primer sequences and probes sequences were used as in EXAMPLE 4 and described in TABLE 5, but with the probe-label (and corresponding quencher) as set out in TABLE 6. For the assays described as V10.5 and V10.6, the same primer sequences, probes sequences and probe-labels/quenchers were used as in V10.1/10.4, except that instead of the DMR located in C21orf57, an alternative second (target) Chr 21 DMR was used: C21orf29 for V10.5 and CGI149 for V2.6. The

TABLE 6

Summary of other non-limiting embodiments of a method of the invention

| Label-quencher (channel) | EXAMPLE 4** | V10.1 | V10.2 | V10.3 | V10.4 | V10.5 | V10.6 |
|---|---|---|---|---|---|---|---|
| Cyan 500-BHQ1 | DSCAM: Chr 21 (DMR) | TBX3 & PCDHGA1: Chr 5 & 12 (ORs) | TBX3 & PCDHGA1: Chr 5 & 12 (ORs) | TBX3 & PCDHGA1: Chr 5 & 12 (ORs) | TBX3 & PCDHGA1: Chr 5 & 12 (ORs) | TBX3 & PCDHGA1: Chr 5 & 12 (ORs) | TBX3 & PCDHGA1: Chr 5 & 12 (ORs) |
| 6FAM-Eclipse | TBX3 & PCDHGA1: Chr 5 & 12 (DMRs) | TBX3 & PCDHGA1: Chr 5 & 12 (DMRs) | TBX3 & PCDHGA1: Chr 5 & 12 (DMRs) | TBX3 & PCDHGA1: Chr 5 & 12 (DMRs) | TBX3 & PCDHGA1: Chr 5 & 12 (DMRs) | TBX3 & PCDHGA1: Chr 5 & 12 (DMRs) | TBX3 & PCDHGA1: Chr 5 & 12 (DMRs) |
| LCRed 610-BBQ650 | TBX3 & PCDHGA1: Chr 5 & 12 (ORs) | DSCAM: Chr 21 (DMR) | C21orf57: Chr 21 (DMR) | C21orf57: Chr 21 (DMR) | DSCAM: Chr 21 (DMR) | DSCAM: Chr 21 (DMR) | DSCAM: Chr 21 (DMR) |
| Cy5-BHQ3 | C21orf57: Chr 21 (DMR) | C21orf57: Chr 21 (DMR) | DSCAM: Chr 21 (DMR) | — | C21orf57: Chr 21 (DMR)* | C21orf29: Chr 21 (DMR) | CGI149: Chr 21 (DMR) |
| LCRed 640-BHQ3 | — | — | — | DSCAM: Chr 21 (DMR) | — | — | — |

*Second supplier of probes, using Cy5/BBQ650 as label/quencher pair for C21orf57 probe

**Except, compared to EXAMPLE 4, using Cy5/BHQ3 as label/quencher pair for C21orf57 probe Sets of samples of cfDNA, each set obtained from 56 or 58 pregnant females, were selected from a large collection of such samples so as to create separate qPCR test runs, wherein each test run included between 2 and 4 cfDNA sequence of each of these two alternative second (target) Chr 21 DMRs is shown in TABLE 7, and the corresponding primers and probe sequences, and the labels/quenchers used in V10.5 and V10.6, are described in TABLE 8.

TABLE 7

Alternative chromosome 21 DMRs

| Chr. | Chr. location | Gene/region | Type | Sequence (5'-3') | SEQ ID No. |
|---|---|---|---|---|---|
| 21 | 44709448-44709552 | C21orf29 | DMR | ACTTGAATAGCCAAATGAGTCCTAGAAAGcgAgAGA CGAGAGGGGAATGA<u>GCGC</u>cGAAAATCAAAGCAGGTT CCCCtCCTGACAACTCCAGAGAAG<u>GCGC</u>aTGGG | 231 |
| 21 | 46667502-46667582 | CGI149 | DMR | CGT<u>CCGG</u>TGAGCCTAAGA<u>CGCG</u>CCTTTGCCGGGGTT G<u>CCGGG</u>TGTCTGCCTCTCACTTAGGTATTAGGAACC GTGGCACAA | 232 |

Methylation sensitive sites are underlined and locations of known SNPs are shown by non-capitalisation

TABLE 8

Primers and probes for the alternative chromosome DMRs

| Chr. | Gene/Region | Component | Sequence (5'-3')** | SEQ ID No.* |
|---|---|---|---|---|
| 21 | C21orf29 DMR | Chr21DMR3-For | ACTTGAATAGCCAAATGAGTCCT | 233 |
|  |  | Chr21DMR3-Rev | CCCATGCGCCTTCTCTG | 234 |
|  |  | Chr21DMR3-Probe | [Cy5]-TCCCCTCTCGTCTCTCGCTTTCT-[BHQ3] | 235 |
| 21 | CGI149 DMR | Chr21DMR4-For | CGTCCGGTGAGCCTAAGA | 236 |
|  |  | Chr21DMR4-Rev | TTGTGCCACGGTTCCTAATAC | 237 |
|  |  | Chr21DMR4-Probe | [Cy5]-CCGGGTGTCTGCCTCTCACTTA-[BHQ3] | 238 |

*Only nucleotide sequence listed, without dyes/quenchers
**The dyes/quenchers used for each probe are shown in "[ ]" parentheses As shown by FIGS. 11 to 17 (which in each case, the x-axis represents DSCAM as one Chr 21 DMR; and the y-axis represents the other Chr 21 DMR), each of these different embodiments was demonstrated to be a direct and efficient method of the invention for NIPT to detect trisomy 21, as distinguishably clustered from the non-T21 samples in each run. In only one assay version (V10.1), "false negatives" were found to occur by true positive samples lying outside of the same pre-defined circular cut-off boundary that was applied to all assays; and of those two false negatives, one was easily identified as being anonymous by having a substantially higher marker ratio for both markers. A small number of false positives occurred in some assays, varying from 0% (V10.4 and V10.5) to 4% (V2.1) of the true negatives quantified in the run, but as will be understood by the skilled person, in a diagnostic test for eg aneuploidy, it is far more important to have minimal false negatives compared to false positives. The pre-defined circular cut-off boundary used in this example was one that had been previously defined—following the analysis of the data obtained from a large randomised blinded set of qPCR test runs using over 700 samples which included 15 T21 samples in the assay format described in EXAMPLE 4—to provide the overall sensitivity (true positive rate), specificity (true negative rate) and non-reportable rate as desired for such test; for example: a sensitivity of 100%, almost 100%, greater than 97% (preferably, greater than 97.5%) or greater than 95%; a specificity of greater than 95%, preferably greater than 96%; and/or a non-reportable rate of less than 10% (preferably less than 7%), such as less than 6% or 5%.

Example 11: Use of a Method of the Invention as a Direct and Efficient Method for NIPT to Detect Trisomy 18 (Prophetic Example)

One or more of the aneuploidy-DMR/label combinations described in EXAMPLE 10 are used as the basis for NIPT to detect trisomy 18 (T18), as briefly described by the following. Using a limited number of samples from T18 pregnancies (a rarer aneuploidy), a method as described in EXAMPLE 4 or EXAMPLE 10 is used (or example, analogous to V10.3), except that one (or two) chromosome 18 DMRs are used for example instead of the two chromosome 21 DMRs. For example, the two chromosome 18 DMR described in TABLE 9 may be used in such an assay, and corresponding primers and probe sequences, and the labels/quenchers used, are described in TABLE 10.

As will now be appreciated by the person of ordinary skill, the exact region of the NFATC2 and/or chr18-gr00094 gene/region that may be used in such assay, and the precise position/sequence of the corresponding primers/probes may be further optimised (such as by using a region that is within about 350 bp, 300 bp, 250 bp, 200 bp, 150 bp, 100 bp, 50 bp, 20 bp, 10 bp or 5 bp upstream and/or downstream of those regions and sequences shown below; preferably between about 350 bp and 200 bp of, or 200 bp and 5 bp thereof). Furthermore, further methylation-sensitive restriction enzymes may be used in addition to those described in EXAMPLE 10, for example to enhance digestion of unmethylated cfDNA. Such additional methylation-sensitive restriction enzymes can include AciI, Cac8I and/or PhoI.

TABLE 9

Chromosome 18 DMRs

| Chr. | Chr. location | Gene/ region | Type | Sequence (5'-3') | SEQ ID No. |
|---|---|---|---|---|---|
| 18 | 79524482- 79524587 | NFATC1 | DMR | CCTGGGCTGTGTCTGGTCCcGGCCACGcGTCCCTG CAGcgTCTGAGACCTTGTGGAACACACTTGACCcG GCGCTGgGACGGGGTCGGCCCACACGCACcgCCAG C | 239 |
| 18 | 13136883- 13136992 | chr18- gr00094 | DMR | GCCCCAGAGCCTCCTTTCGGGGCGCqAGGCCcGGC GCGTGTGTACGGAGTCCAGTCCCCCAGGGAGTGG GGTGCCCGCACCTTCttCCTCCGCGCTCGGAGCCA CAGGGG | 240 |

Methylation sensitive sites are underlined and locations of known SNPs are shown by non-capitalisation

TABLE 10

Primers and probes for the alternative chromosome DMRs

| Chr. | Gene/ Region | Component | Sequence (5'-3')** | SEQ ID No.* |
|---|---|---|---|---|
| 18 | NFATC1 DMR | Chr18DMR1-For Chr18DMR1-Rev Chr18DMR1-Probe | CCTGGGCTGTGTCTGGTCC GCTGGCGGTGCGTGTG [LCRed640]- TGGAACACACTTGACCCGGCGCT-[BHQ3] | 241 242 243 |
| 18 | chr18- gr00094 DMR | Chr18DMR2-For Chr18DMR2-Rev Chr18DMR2-Probe | GCCCCAGAGCCTCCTTTCG CCCCTGTGGCTCCGAGC [LCRed610]-TGCGGGCACCCCACTCCCTG- [BBQ650] | 244 245 246 |

*Only nucleotide sequence listed, without dyes/quenchers
**The dyes/quenchers used for each probe are shown in "[ ]" parentheses In view of the above, it will be appreciated that the present invention also relates to the following items:

1. A method for detecting a chromosomal aneuploidy in a foetus carried by a pregnant female, said method comprising the steps:
   (a) providing a sample taken from said pregnant female, which sample comprises DNA that originates from cells of a foetus and/or the placenta of a foetus in admixture with differently methylated DNA of maternal origin;
   (b) treating the DNA present in said sample with a reagent that differentially modifies methylated and non-methylated DNA;
   (c) determining an amount of a first target species of DNA, being the chromosome relevant to the chromosomal aneuploidy, in said sample by detecting in said sample the presence of methylation at two or more first target differentially methylated regions (DMRs) located on said chromosome, said first target DMRs differently methylated between DNA that originates from cells of a foetus and/or the placenta of a foetus and DNA of maternal origin, the modification of DNA of the first target DMRs by said reagent is sensitive to methylation of DNA, wherein a detected amount of methylated DNA at one or more of said first target DMRs indicates said amount of first target species of DNA in said sample;
   (d) determining an amount of reference species of DNA, being one or more reference chromosomes, in said sample by detecting in said sample the presence of methylation at two or more reference DMRs located on said reference chromosome(s), said reference DMRs differently methylated between DNA that originates from cells of a foetus and/or the placenta of a foetus and DNA of maternal origin, the modification of DNA of such reference DMRs by said reagent is sensitive to methylation of DNA, wherein a detected amount of methylated DNA at one or more of said reference DMRs indicates said amount of reference species of DNA in said sample; and
   (e) determining relative amount(s), preferable ratio(s), of an amount determined from step (c) and an amount determined from step (d), wherein one or more of said relative amount(s) indicates the presence or absence of the chromosomal aneuploidy in the foetus,
   wherein, said detections in step (c) and step (d) are made using the same aliquot of DNA of said sample, and in the same vessel, and effectively simultaneously for said first target DMRs and said reference DMRs, and using: (x) the same detectable labels(s) for at least two of said reference DMRs; and (y) a different detectable label(s) for at least two of said first target DMRs; preferably:
   wherein in step (e) said relative amount(s) or ratio(s) are compared with threshold(s) and/or reference distribution(s), wherein one or more of said relative amount(s) or ratio(s) higher or lower than said threshold(s) and/or reference distribution(s) indicates the presence of the chromosomal aneuploidy in the foetus.
2. The method of item 1, wherein two or more of said reference DMRs are located on different reference chromosomes.

3. The method of item 1 or 2 further comprising the step:
   (f) determining an amount of total DNA in said sample by detecting at least one other region (OR) that is not differently methylated between DNA that originates from cells of a foetus and/or the placenta of a foetus and DNA of maternal origin, the modification of which OR(s) by said reagent is insensitive to methylation of DNA,
   wherein, said detections in step (c) and step (d) and step (f) are made using the same aliquot of DNA of said sample, and in the same vessel, and effectively simultaneously for said first target DMRs and said reference DMRs and said other region(s), and using:
   (x) the same detectable labels(s) for at least two of said reference DMRs; and (y) a different detectable label(s) for at least two of said first target DMRs and for at least one of said OR(s); optionally:
   (A) wherein said OR(s) is(are) located on one or more reference chromosome(s), preferably at least one of said ORs being located on the same reference chromosome(s) as at least one of said reference DMRs; and/or
   (B) wherein said OR is located between about 20 bp and 20 kb upstream or downstream of, and/or within the same gene as, at least one of said reference DMRs.
4. The method of item 3, (A) wherein said detection in step (f) comprises using at least two of said ORs; preferably wherein, the number of said ORs is the same as the number of reference DMRs used in step (d); more preferably wherein, one of said ORs is located on the same chromosome as, such as between about 20 bp and about 20 kb upstream or downstream of, a reference DMR used in step (d) and each other of the said ORs is located on the same chromosome as, such as between about 20 bp and about 20 kb upstream or downstream of, another of said reference DMRs; and
   (B) wherein said detection in step (f) is made using: (x) the same detectable label(s) for each of said ORs.
5. The method of any one of items 1 to 4, wherein said detection step (c) and step (d), and optional step (f), are made using the same aliquot of DNA of said sample, and in the same reaction/detection vessel, and effectively simultaneously with each other, and by multiplex real-time quantitative probe-based PCR using at least one labelled probe specific for each of the said DMRs and optional OR(s).
6. The method of any one of items 1 to 5, wherein said species of DNA that originate from cells of a foetus and/or the placenta of a foetus is circulating cell-free DNA and said sample is a blood fraction such as plasma or serum.
7. The method of any one of items 1 to 6, wherein said reagent that differentially modifies methylated and non-methylated DNA comprises: (A) bisulphite; or (B) an agent that selectively digests unmethylated over methylated DNA, preferably wherein, said agent comprises: at least one methylation sensitive enzyme;
   at least one methylation sensitive restriction enzyme; and/or
   an agent selected from the group consisting of: AatII, AciI, AclI, AfeI, AgeI, AgeI-HF, AscI, AsiSI, AvaI, BceAI, BmgBI, BsaAI, BsaHI, BsiEI. BsiWI, BsmBI, BspDI, BsrFI, BssHII, BstBI, BstUI, ClaI, EagI, FauI, FseI, FspI, HaeII, HgaI, HhaI, HinP1I, HpaII, Hpy99I, HpyCH4IV, KasI, MluI, NaeI, NarI, NgoMIV, NotI, NotI-HF, NruI, Nt.BsmAI, Nt.Cvi-PII, PaeR7I, PluTI, PmlI, PvuI, PvuI-HF, RsrII, SacII, SalI, SalI-HF, SfoI, SgrAI, SmaI, SnaBI, TspMI and ZraI.
8. The method of any one of item 1 to 7, wherein one reference DMR is located on human chromosome 5 and another reference DMR is located on human chromosome 12; preferably:
   wherein each of said first target DMRs is located on human chromosome 21, on human chromosome 18 or on human chromosome 13, preferably on human chromosome 21; optionally:
   (A) wherein said DMRs are hypermethylated in foetal DNA and hypomethylated in maternal DNA; and/or
   (B) wherein said DMRs comprise at least one, preferably at least two, methylation site(s) specific for said reagent.
9. The method of any one of items 1 to 8,
   (A) wherein said first target DMRs are each located in a region and/or gene independently selected from:
   one disclosed in WO 2011/092592, including on selected from the list consisting of: EP1, EP2, EP3, EP4, EP5, EP6, EP7, EP8, EP9, EP10, EP11 and EP12 [SEQ ID NOs 33-44] of WO 2011/092592; or
   the list consisting of: AIRE, SIM2, and ERG or a DNA sequence of no more than 10 kbp, 5 kbp, 1 kbp, 500 bp, 250 bp, 150 bp, 100 bp or 50 bp upstream and/or downstream from such region and/or gene; or
   the list consisting of: PDE9A, PPP1R2P2, CBR1, DSCAM, C21orf29 and HLCS or a DNA sequence of no more than 10 kbp, 5 kbp, 1 kbp, 500 bp, 250 bp, 150 bp, 100 bp or 50 bp upstream and/or downstream from such region and/or gene; or
   C21orf57 or a DNA sequence of no more than 10 kbp, 5 kbp, 1 kbp, 500 bp, 250 bp, 150 bp, 100 bp or 50 bp upstream and/or downstream from such region and/or gene; or
   the list consisting of: SEQ ID NOs: 33, 34, 35, 36, 37, 38, 39, 176, 179, 180, 184, 188, 189, 190, 191, 193, 195, 198, 199, 200, 201, 202, 203, 205, 206, 207, 208, 209, 210, 211, 212, 213, 214, 221, 223, 225, 226, 231, 232, 233, 235, 239, 241, 257, 258, 259, and 261 of WO 2011/034631; or
   (B) wherein said first target DMRs are each located in a region and/or gene independently selected from:
   VAPA-APCDDI or a DNA sequence of no more than 10 kbp, 5 kbp, 1 kbp, 500 bp, 250 bp, 150 bp, 100 bp or 50 bp upstream and/or downstream from such region and/or gene; or
   maspin or a DNA sequence of no more than 10 kbp, 5 kbp, 1 kbp, 500 bp, 250 bp, 150 bp, 100 bp or 50 bp upstream and/or downstream from such region and/or gene
   the list consisting of: SEQ ID NOs: 21, 22, 23, 24, 25, 26, 27, 28, 29, 30, 31 and 32 of WO 2011/034631; or
   (C) wherein said first target DMRs are each located in a region and/or gene independently selected from:
   the list consisting of: SEQ ID s: 1, 2, 3, 4, 5, 6, 7, 8, 9, 10, 11, 12, 13, 14, 15, 16, 17, 18, 19 and 20 of WO 2011/034631.
10. The method of any one of items 1 to 9, wherein said reference DMRs are each located in a region and/or gene independently selected from:

the list consisting of: RASSF1A, TBX3, ZFY, CDC42EP1, PCDHGA1, SOX14 and SPN or a DNA sequence of no more than 10 kbp, 5 kbp, 1 kbp, 500 bp, 250 bp, 150 bp, 100 bp or 50 bp upstream and/or downstream from such region and/or gene; or the list consisting of: SEQ ID NOs: 40, 41, 42, 43, 44, 45, 46, 47, 48, 49, 50, 51, 52, 53, 54, 55, 56, 57, 58, 59 and 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162 and 163 of WO 2011/034631.

11. The method of any one of items 1 to 10, wherein (A) one of said first target DMRs is located in DSCAM and another of said first target DMRs is located in C21orf57 or a DNA sequence of no more than 10 kbp, 5 kbp, 1 kbp, 500 bp, 250 bp, 150 bp, 100 bp or 50 bp upstream and/or downstream from such region and/or gene; and (B) one of said reference DMRs is located in TBX3 and another of said reference DMRs is located in PCDHGA1 or a DNA sequence of no more than 10 kbp, 5 kbp, 1 kbp, 500 bp, 250 bp, 150 bp, 100 bp or 50 bp upstream and/or downstream from such region and/or gene; preferably wherein: (i) one of said first target DMRs comprises SEQ ID NO.: 201 and another of said first target DMRs comprises SEQ ID NO.: 219; and (ii) one of said reference DMRs comprises SEQ ID NO.: 203 and another of said reference DMRs comprises SEQ ID NO.: 220.

12. The method of any one of items 1 to 11,
(A) wherein a plurality of sets of determinations are made for step (c) and step (d), and optional step (f), with each set of said determinations made using a different aliquot of DNA of said sample, in a different vessel and effectively simultaneously with each other member of the plurality of sets of determinations; and
(B) wherein the relative amount(s) or ratio(s) determined in step (e) is determined from said plurality of sets of determinations made for step (c) and step (d), and optional step (f), preferably by using an average amount of DNA determined for each set, such as a mean, median or mode amount of DNA determined for each set, preferably a mean amount of DNA determined for each set.

13. The method of any one of items 1 to 12,
(A) wherein an amount of the first target species of DNA is determined from the detected amount of methylation at one of the first target DMRs and an amount of the first target species of DNA is determined from the detected amount of methylation at another of the first target DMRs; and
(B) wherein two or more relative amount(s), preferably ratio(s), are determined in step (e) for two or more amounts of first target species of DNA, each in respect of one or more of said first target DMRs; and
(C) wherein two or more of said relative amount(s) or ratios indicate the presence or absence of the chromosomal aneuploidy in the foetus; preferably:
wherein in step (e) two or more of said relative amount(s) or ratio(s) are compared with threshold(s) and/or reference distribution(s), wherein two or more of said relative amount(s) or ratio(s) higher or lower than said threshold(s) and/or reference distribution(s) indicates the presence of the chromosomal aneuploidy in the foetus.

14. The method of any one of items 1 to 13, wherein in step (e) said relative amount(s) or ratio(s) are compared with threshold(s) and/or reference distribution(s), wherein one or more of said relative amount(s) or ratio(s) higher or lower than said threshold(s) and/or reference distribution(s) indicates the presence of the chromosomal aneuploidy in the foetus; and wherein a threshold and/or reference distribution is determined from a plurality of samples, each sample taken from a different pregnant female, such as by practicing the method as set forth in any one of items 1 to 12 on such samples, wherein said method is conducted on a plurality of samples each taken from a different pregnant female, each method conducted in a separate vessel, and effectively simultaneously with each other member of the plurality of samples; optionally wherein a plurality of sets of determinations are made for step (c) and step (d), and optional step (f) for each sample such as by practicing the method as set forth in item 12; optionally:
(A) wherein two or more groups of such plurality of samples are analysed on a group-by-group basis, such as each group analysed in a separate run, assay or microtiter plate, and the threshold and/or reference distribution is determined by normalisation of the amount(s) or ratio(s) determined from each group of samples; preferably: wherein said normalisation between groups of samples is conducted by considering the difference between a sample-specific amount or ratio (such as a mean of sets of determinations made for such sample) and an average (such as a median) of the amount or ratio determined for all samples in the same group as said specific sample; and/or
(B) wherein the presence of the chromosomal aneuploidy in the foetus is indicated by the sample-specific amount or ratio in respect of such foetus that is an outlier compared with threshold(s) and/or reference distribution(s) of amount(s) or ratio(s) determined in respect of to one or more of the first target DMRs: preferably:
wherein the presence of the chromosomal aneuploidy in the foetus is indicated by the sample-specific amount or ratio in respect of such foetus being located within a numerical cluster located: (a) outside a cluster of sample-specific amounts or ratios in respect of a plurality of other foeti that are (presumed) euploid; and/or (b) within a cluster of sample-specific amounts or ratios in respect of a plurality of other samples representing foeti having the chromosomal aneuploidy; preferably wherein said plurality of other samples representing foeti is selected from the group consisting of about: 2-10, 12-15, 16-25, 26-30, 32-40, 42-50, 52-75, 78-100, 105-125, 130-150, 155-175, 180-200, 205-250, 255-300, 305-350, 355-400, 405-450, 455-500 and more than 500 other such samples 15. A kit, preferably for detecting a chromosomal aneuploidy in a foetus carried by a pregnant female and/or for detecting an increased risk of a pregnant female suffering from or developing a medical condition, said kit comprising:
a combination of primers and/or probes wherein said combination comprises two or more labelled probes, optionally each probe having a different detectable label, each probe specific for and for detecting one of said two or more first target DMRs, such as by real-time quantitative PCR; optionally the combination further comprising:

(A):
two or more pairs of PCR primers, each pair for amplifying one of said two or more first target DMRs as set forth in any of items 1 to 14; and/or two or more labelled probes, optionally each probe having the same detectable label, each probe specific for and for detecting one of said two or more reference DMRs, such as by real-time quantitative PCR; and/or two or more pairs of PCR primers, each pair for amplifying one of said two or more reference DMRs as set forth in any of items 1 to 14; and/or (B):
at least one further pair of primers (preferably two further pairs of primers), each pair for amplifying one of said at least one OR as set forth in any of items 3 to 14; and/or at least one further labelled probe (preferably two further labelled probes), optionally each probe having the same detectable label, each probe specific for and for detecting at least one of said ORs, such as by real-time quantitative PCR; and optionally, said kit further comprising:
(i) a printed manual or computer readable memory comprising instructions to use said primers and probes to practice a method of any one of items 1 to 14; and/or (ii) one or more other item, component or reagent useful for the practice of a method of any one of items 1 to 14, including any such item, component or reagent disclosed herein useful for such practice or production.

16. A computer program product comprising: a computer readable medium encoded with a plurality of instructions for controlling a computing system to perform and/or manage an operation for detecting a chromosomal aneuploidy in a foetus carried by a pregnant female from a sample taken from said pregnant female, which sample comprises DNA that originates from cells of a foetus and/or the placenta of a foetus in admixture with differently methylated DNA of maternal origin, the DNA present in said sample being treated with a reagent that differentially modifies methylated and non-methylated DNA as set forth in any one of items 1 to 14; said operation comprising the steps of:

receiving: (i) two signals, each representing an amount of the first target species of DNA, being the chromosome relevant to the chromosomal aneuploidy, present in said sample as set forth in step (c) of any one of items 1 to 14; and (ii) one signal representing an amount of reference species of DNA, being one or more reference chromosomes, present in said sample as set forth in step (d) of any one of items 1 to 14;

determining a classification of whether a chromosomal aneuploidy is present in the foetus carried by said pregnant female based on at least one relative amount(s) of the chromosome relevant to the chromosomal aneuploidy represented by at least one signal received in (i) compared to an amount of reference chromosomes represented by the signal received in (ii), wherein at least one indicates the presence or absence of the chromosomal aneuploidy in the foetus; optionally:

(A) wherein the signals representing said amounts of DNA determined in step (c) and step (d) are generated using the same aliquot of DNA of said sample, and in the same vessel, and effectively simultaneously for said first target DMRs and said reference DMRs; optionally using: (x) the same detectable labels(s) for at least two of said reference DMRs; and (y) a different detectable label(s) for at least two of said first target DMRs; and/or (B) wherein said operation conducts such classification by making comparison to threshold(s) and/or reference distribution(s), wherein one or more of said relative amount(s) or ratio(s) higher or lower than said threshold(s) and/or reference distribution(s) indicates the presence of the chromosomal aneuploidy in the foetus; preferably: wherein said operation computes said threshold(s) and/or reference distribution(s) from a plurality of samples each taken from a different pregnant female by receiving a plurality of signals (i) and (ii) in respect of said plurality of samples; optionally wherein said plurality of samples is analysed in one or more groups of samples by a method of any one of items 1 to 14 and wherein said method is conducted on each sample in a given group in a separate vessel, and effectively simultaneously with each other member of the plurality of samples in such group; and/or (C) wherein said operation further comprises the steps:

receiving (Hi) a further signal representing the amount of total DNA in said sample as set forth in item 3; and determining an amount, such as an absolute or relative amount, of foetal DNA present in the sample by consideration of the signal received in (Hi) with at least one signal received in (i) and/or (ii); preferably:

wherein said operation further comprises the step of:

determining a classification of whether the pregnant female has an increased risk of suffering from or developing a pregnancy-associated medical condition based on comparing said amount of foetal DNA present to a threshold and/or reference distribution, wherein an increase in, or outlying of, the amount of said foetal of DNA from said threshold and/or reference distribution indicates an increased risk of the pregnant female suffering from or developing said pregnancy-associated medical condition.

SEQUENCE LISTING (246 sequences)

SEQ ID NO: 1 - DNA, 20 bp, Artificial Sequence
  Description of Artificial Sequence: Synthetic Primer
attgagctgcgggagctggc

SEQ ID NO: 2 - DNA, 18 bp, Artificial Sequence
  Description of Artificial Sequence: Synthetic Primer
tgccgtgtggggttgcac

SEQ ID NO: 3 - DNA, 15 bp, Artificial Sequence
  Description of Artificial Sequence: Synthetic Probe
acccggctggagcgt

SEQ ID NO: 4 - DNA, 20 bp, Artificial Sequence
  Description of Artificial Sequence: Synthetic Primer
ggtcatccaccaccaagaac

SEQ ID NO: 5 - DNA, 20 bp, Artificial Sequence
  Description of Artificial Sequence: Synthetic Primer
tgcccaaggatgctgtcaag

SEQ ID NO: 6 - DNA, 20 bp, Artificial Sequence
  Description of Artificial Sequence: Synthetic Probe
gggcctcaatgacttcacgt

SEQ ID NO: 7 - DNA, 20 bp, Artificial Sequence
  Description of Artificial Sequence: Synthetic Primer
ggtgcgaactcctctttgtc

SEQ ID NO: 8 - DNA, 20 bp, Artificial Sequence
  Description of Artificial Sequence: Synthetic Primer
ttaatcacccagcgcatggc

SEQ ID NO: 9 - DNA, 20 bp, Artificial Sequence
  Description of Artificial Sequence: Synthetic Probe
ccctcccggtgggtgataaa

SEQ ID NO: 10 - DNA, 20 bp, Artificial Sequence
  Description of Artificial Sequence: Synthetic Primer
tgttcactggaggactcatc

SEQ ID NO: 11 - DNA, 19 bp, Artificial Sequence
  Description of Artificial Sequence: Synthetic Primer
cagtccatgagggtgtttg

SEQ ID NO: 12 - DNA, 18 bp, Artificial Sequence
  Description of Artificial Sequence: Synthetic Probe
gaggtcccattctccttt

SEQ ID NO: 13 - DNA, 18151 bp, Homo sapiens
  RASSF1
gacttggcgtctgaggacagagtccagaccacaaggatctggagctcaggagagactcgtgggccacagcccgagaaagcgctgggaatccaaatactatggcgattggcagtcgcgtaggcgaggcgggctagagacccgcccggatttaggcgcgagccacctccaggggcggggcccaggccgcactgcgcaggcgcggctaacccgtttccatggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggtgaggcacccgggtcaggcggagtcccggagtcattgtccttgagtcggggagctggggcctgactcgggggaggggctgcccagtgtggaggggctcccaaatgggggagcagagcgttccgagacaggagtattactgctcctgagccccctgtgtcccctcaggatcaggttaggcttcagtaggatccagcccccatccccactcctaatgcacacacgtggacgcacatgcacttaccctctgaggcaggtggaaccagcagcatgagaacctggagaagctgaacatgcaagccatcctcgatgccacagtcagccagggcgagcccattcaggagctgctggtcacccatgggaaggtaccccgaggtcacaggcagggttcctgccttcccccatacctcacctactctacccctccggagtcccctgtgtgcccttcccctctggcctggtacacctgttctccctgaaggacaaagaggaatgtgttacatgtttcattttgtatccctattggacaggactctggcacaccaggctgggtgcagggcatgagttgattagggagaaagctgtaggtcctagaacagcttaggcttcaaggggaaggcccaaatgctaaaggcatctgtgaattgactgtaaggctggtggtggggaaggggtggggaggggttggggagggcgggagggaggggagataacctaactggaggtggaacttcggcatggaaggaagcagccttcccaacatgaaagggggaagttagaaaccagggagatgcctggctggaacatggaccagggagtgtcaccagcagatgacctgagatatcaattgaccaaaaaaaaaaaaaaaaaagccgggcatggtagctcatgcctgttatcccagcattttgggaggccaagacgggtggatcatctgaggtcaggagttcaaggccagcctggccaacatggtgaaaccccacctctactaaaaatacaaaaatttgcagagcatggtggtgcacacctgtaatcccagctactcgggaggctgaggcaggagaatcgcttgaacctgggaggcagaggttacagagagccaagatcatgccactgcactccagcctgggtgacaagagtgaaactccgtctcaaaaaaaaaaaaaaaaaaaagaaaggtcctttgcaaaagaaagatggaactcatactaggggataggataggaacagggcactgtgaagggtcctgagtaggagtgaggccaaggcacacaagagctttggaggaccacagacagggactagagggagggcatgaggagaagggctggcttgaaagggatgcctgaatgggcgggcagaggataagggtgcaggtgcaggcagggcaaggcagtctgggaactgggcaggagccagtcacataagcatgagggacatccacagaggtgttgggagcagctggtaatgaaggtccaaggtgcaagagagaagtcaggaaggatactcatgggtctggaatagtttaggggcccagcagtgtttggggatatcagggttgagctgagccggggatgggagggttgccaggcaaaggtaggcccatctcatccctgtcctttaccctacccttcaaaggtcccaacactggtggaggagctgatcgcagtggagatgtggaagcagaaggtgttccctgtgttctgcagggtggaggacttcaagccccagaacaccttccccatctacatggtggtgagctgggcccctggttcatacctcttctcactccttcagagggctctggaccggggaggagagctggtagcccctatcccttcctcaggccctgtccttctctttatctgacaggtgcaccacgaggcctccatcatcaacctcttggagacagtgttcttccacaaggtgagggactatctctgcccatgggccacagttccgggtcagggcctggcaggaagggagattgtgtctgtgtggggaaggcatcagacacagaaagtttccctcctccttttcccaggaggtgtgtgagtcagcagaagacactgtcttggacttggtagactattgccaccgcaaactgaccctgctggtggcccagagtggctgtggtggcccccctgagggggagggatcccaggacagcaaccccatgcaggtgggttgaggttacctagggttgtgaaagcctaggtctgggttccccaaggcctgcgcaggtgagggtggcccagcgtgaacactgtgtgacctcccaggagctgcagaagcaggcagagctgatggaatttgagattgcactgaaggccctctcagtactacgctacatcacagactgtgtggacaggtgagcagtccgactgggcctgggcctactgtggagggctggaagaccgggcctgtagcctgcctctactcacctccttcacaacgtccctgcccctagcctctctctcagcaccttgagccgtatgcttagcacacacaacctgccctgcctcctggtggaactgctggagcatagtccctggagccggcgggaaggaggtagggtcctcccccaccagcctaagccccaggctactgcttcagggtatctttttgatagaggggggcagcttgcacacacgaagacaaaccctgtccccaagcccactgaggataccaggatgcctcagccaaggttggcctagacctgagctctgcagcaggccaggcccatgtgtccactactgaggctcaccctgctctggggtcagcagccctatagcctgggcaagtcctgcagcccaggttctcccattcccaggcagtggtcagtctcccagcccccacagctggctcacttgaagagaattcaacgtctgcacccagtgtgctggttcctctccccaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaaggtcagactccctccgcaccagcccccacagccccagtaccgccctccccatcctaccccgactgcgtccctgctgtttatctttgcccacccacctcaaccccagtgctcttttcagtccttgggcctcaggtgacacaccagctagtgggacatgggcccccacaggcattctcagcccaacccagccccttccttttccttggccccctggccagcacctgcatcacactggcctccactggacacccttgcagcttcgggccttcctcacagacacactgctggaccagctgcccaacctggcccacttgcagagtttcctggcccatctgaccctaactgaaacccagcctcctaagaaggacctggtgttggaacaggtaggcactggaaagttagctgctcaggaccactgtcccactttaccagcaccttcctgccactctccacttctctctcctagatcccagaaatctgggagcggctggagcgagaaaacagaggcaagtggcaggcaattgccaagcaccagctccagcatgtgttcagcccctcagagcaggacctgcggctgcaggcgcgaaggtaaggcctgtggaaatggcagggagggtggaggggatgcaggaggcatggatgtgggtggggtgcccccaccttccagggccagtcagaccttcctgactttcccccaggtgggctgagacctacaggctggatgtgctagaggcagtggctccagagcggccccgctgtgcttactgcagtgcagaggcttctaagcgctgctcacgatgccagaatgagtggtattgctgcaggtgagggtatcctagaaccttggacctctaagccctactcccacatcccccacatgcattgccatcctcaatacccacctgcctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaacacgggtatctccgcgtggtgctttgcggtcgccgtcgttgtggccgtccggggtggggtgtgaggaggggacgaaggagggaaggaagggcaaggcggggggggctctgcgagagcgcgcccagccccgccttcgggccccacagtccctgcacccaggtttccattgcgcggctctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgtgagtagtggccccgcgcgcctacgagagcggaaggggcagccaaggggcagcgcagtcgccgcgggtcaagtcgcggcagagggggtcggcggggacagctcccgaggactaggtccgttactttcgccccatcgctgaagagtgcgcgaaaatggtttatcccttgtcgcactccactcgtatctgggccacagatgagcagaggtggctgcttatatgtaaaaatacgctgattttaagtttcttatctttaaaatgccttggcccttcttgagaaagggtttgtgcctactgtcctcggagtccatcttcccaggcttgcctcttctcaaacactcatgaccccctccagaacctttagggtgaagggaaattaccacctatgggagggagcctggaaaaatttagaacctttggtgggccccctgcaagcaggagttttgttgagtctttatttagcaaacacccttttctgacccagtgaatcagatgctaaaatatgcacgcagccacacacccagcagtccttctgcacccctgggaatcgccagcaagcaaaggttgctctcccctgggtagacaccagctggaatcaccaggggtgcttttacagtcctccccgctagcctggatcccaccgcagacctgttgaatcaactgctgggagtggaccctaggcatcagtaaattttaaaaactccccaaattattgtaacatggagtctgggttgagcatcactgctctggcctatttaggaacttgtggatggatagtgtcccaggtctgtgtgtgcatggagaccctctcatccggtacaagaggacatcacaaattcagctggggggagcacaaagttgtgacagaatgcaaagaatgaacaaggggccgagcgcggtggctcatgcctgtaatcccagcacttcggaaggcggaggcgggtggatcacctgaggtcaggagttcaagaccagcctggccaacatggtgaaacctcatgtctactaaaaaataaaaaaaaatgagccaggcgtagtggcgggtgcctgtaatcccagctactcgggaggctgaggtgggagaattgcttgaacacaggaggcggaggttgcagtgagccgagatcgtgccactgccctccagccttggcgacagagtgagactctgtctcaaaaaaaaaaaaaaaaaaaaaaagaacaaggctgggacattgcagcgttctcaaagagaaataaagtagccatggagataagaagcaggatgatttgggcatgtttatcagaggtagagacaagggagaaatcaaagataagtttgggcttttgtctccagtaactgggagcctagtggccatttttgctgcaaagaggaagctgggcaagtgtagcagtgaggctgaagaaaagggaattaaattttggccatgttcacttgaaacgtcttttagacatcctagtgaaggtactggcacggaggatctagtctgagggtttaggtcagtgtttcagccgtggatctggggcagatgaatgtagacagaccaggccagtgatcaggactgagcccagacttcatcgtgagatatggaagttgagtcagaatctgcaaaggagctgagcaggagctgcagggggtaggaggaaaactgggagagtgtagcccctgggagtcaaagggagcaagcttcaaatgatgctgagggggtgagaatggagaatggaacactggattccatttggtagtacacagatcgctgaggaccctgtcccgggcagtttcctggaggaagaggcaagcctggctggagtgggtagaggggagagtgaaggcgaaggattagagtgtatagagaccagtgtcttggtctgaggggagtagagacaggtgacaaccacagggcagacgtaggttaaaggtgtttagtttttccttcaagtaaatgggcagatgtattccatatacgttcccagtgaagggccgggtgcggtggctcaagcctgtagtcccagcactttggaaggccgaggcgggtggatcacctgagatcaggagtttgagaccagcctggctaacatggtgaaaccccgtctctactaaaaatacaaaaattagctgggcatggtggcgggcgcctgtaatcctaggtactcaggaggctgaggcagaagaatcgcttgaacccaggaggcggaggttgcggtgagccgaaatcgcgccattgcactccagcctgggtgacaaaagcaagacgcagttttttgttgttgtttttttaattgccaatgaggaaaggggaagttctgtgctaggcgatagagatccaactgttgagcaggcctctctgcctgtggccttccggccggtttccagacgcccaggtggccaacattagagtccgcgtagcagtgtgaggtaacccactgagataggtcgggcctgcggagcctggcgagcagcggccctctccctggggcttcccttcaatctccgggacatttccccgacctggagctcctccgcctcaccgccaggcctctctgcagattgcaagttcacctgccactaccgctgccgcgcgctcgtctgcctggactgttgcgggccccgggacctgggctgggaacccgcggtggagcgggacacgaacgtggtgagcgcggggccgagggcgtatgggaagggcgaggatgggcaggccacagtgcaggcattctcgagggctgcctgggtgccgcgcgcaaggagcgttctaattgccgatttcccggcggcacagagaggctaattctgcgcgggggctgggaggggagcctggattgccggctccgcaagtactccacccgctgcaagcggacccgggcccaggctgacccaggctccgcgcacgcgcacttcccgcaccttcccgccctcgcctccggccagaggccactcttgtgcgcttgcccggacgctggcacccgcccccgttccctgtggtaggtggggtctgtgagtggagctccggagcgatgaggtcattcctgggggcgaagcgtgcgtgtccccgccccggcgttcctgccccaatgagacaagagctagatcccggcgatctacgtttcagtcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggtgggagccagggggtgccggcgggcgggaggggaagcggtcgctggagctccgccctccccggtccgttgccgcgtcctgggtcggtgggcagccccaccctcctggctacgtggctccccgcgggtcctggccggggacctgcccgcggaaccgtgcgtaagaccccgattccaccgcctagatgctgggtgccggggcccccttggtttctgtcacagacaggttgaacacggaaaaagcagctgtatggcttgtggtagacctgagccgggcattatccagctatgactaaagccgaccgagcagtttggactagcacctcgatttccgcgttcgaatgctcctgctccctccttggggagactaggggaggatgtggagagggaagagtcctcgccaggaattgagaagtatgtttaggaaaacttgagaggcagagagagatcctgctcctccatctgcactcctgtatggagccagctgagccctcacctcttccctgttctggcctgtcaccagctgctggaatgtggaagattctgttcccttcctctagggtggatctggagaaagatttgggaatagataggaaagaagtcttgttttggaccataagcattcaggagcactttacccacaggaagggggaaagctagattataaaatgcctaaagaggtggaaaaagagatccaggttactaacccaggactgtaaggtgtctcggaacctcctaggtatccccattatcggagaactgtgtgccagatgccattggtgtgaccaccaggctcagagaaccaggcctaggcaccaggaaaaagaaacagggactgtgaagctcagtatgcctggcagaaatggggcggaaatccttatttaagtaaagaaagtggagttgtgagtgatgcttcagataaaattttacaaaattccttacaaaatgggtggtgctcagcacgccaaaatcttagcccagagcttgggtgcaagggttgagttgagtgtagacccctgggcttgtcttcatgtcagtcagtcctgagccattttccactgtggaaaggtgggaaaaccacaagacactaaccaattgaaaaggagggctagccacggaggtgcacacctgtaatcccagctacttgggagggtgaggcagaaggatcacttgaacctgggaggcagaggttgcagtgagccaagatcgtgccactgcactccagcctgagtgacagagtgagactctgtctcaaaaatagaaaaggaagccaagtacggtggctcacacctctaatgccaatgctttgggaggccaaggcaggtggatcatttgcaatcaggaattcgaggtcagcctggccaacatggtgaaaccctatctctactaaacatacaaaaattagccgggcatggtggtgtgtgactgtagtcccagctacttgggagactgaatcacttcaaccgggaggcaaaggttgcagtgagccaagatcgtgccactgcactccaacctgggtgacagggtgaggctctgtctcaaaaaaaagaaagaaggctgggcttggtgactcatgcctgtaatctcagcattttgggaggccaaggcaggcagatcacttgaggccaagagttcgagacctgccaggccaacatagcaaaaccccgtctgtactgaaaatacaaaaaaattatctggccatggtggtgtgtgcctgtaatcccagctactggggaggctgaggcaggagtatcacttgaacccagaagacagaggttgcagtgagtcgagactgggccactgcattccagcctggatgagagagcaagactctgtctcaaaaaaaaaaaaaaaaaaaaagaaagaataggaggctgagaagtcccaagttatatgttaaaaaaaaagaaaaaaacatcagttttaggccaggtgcagtggctcacacctttaatcccagcactttggaaagccgaggtgggtggatcatgaggtcaggagttcaagaccagcctggccaaaatggtgaaaccccgtctcgactaaaaatacaaaaaattagccagttgtggtggcaggcacctgtaatcccagctacttgggaggctgaagcagagaattgcttgaacccaggaggcagagattgcaatgagccaagatcgcaccactgcactccagcctggaaaacagagcgagactctgtctcaaaaaaaaaaccatcagtttttatggacagtggtagagtggagggtgggtccctatggtgcagaagggaaattccatggtcctgctgtgcatccgactgggatggctgttgaaatcctcttccagcaggcagctttggaaacagaaaaagaaactcttcctcctttagaatcctggaagggctgtgcagtgcctctaatccaagtctgttttctgagtgaagatagggaggttcatcaccagaagggaaggggctggaaatgaggtcactgcatcccagcccagggctcctgggtcatccaggaagggaagaaggagcaagctttctcattgttaggtaggagctcagagccatcacaagaacaagttagcaccatccctgtgccctccctgttctgcaaacaaaatgatcttccttcttgccctggcactagagtctgtctggcatttctcctgcccctagtactcctcccatctgggtacttcttcccgttggtgtactgaacaaacacatccactgctttattcacagcctccagccctcattttccagggcccacaccatttgtttttactaacccgacaaggttgcccactgtccccagtaaggtttgtactggggtttttactccagtgctcttctccatccaggagacctttggatacttggggaagaaaatgagcttaaattcccacccctccccctttacctttttcctgtaaggccctggccttagttcttagccccacatccttgctggctgcagaatagcagcgggttctgggtaaggagcattctgctaaaacgctccaccctgctccctcatctgtcctctccatttgtccccatcagatggtttaagtgcttaaggggactccagggcggagtcagggagaaccctggctctcctgggctaggcacaagatcattctacaggaaaccttgtgggaattcttctgggacaaagtattggtcagcgctgagcttagctgtgtctgtgacactcgcattctaactagggcctatctgacgtcaacaggaagtaaggctgatgcagtggggccaagggagtctgggagaagaaagtcggttcagagccctggctgccctgtcccacactccacccttccggcaagaatccagtccctagatgaggtggggagtgagtggtcgagttaaaaatctctgggtcgggtacgatggttcacgcctgtaatcccagcactttgggaggtgaaggcaggcggatcacttgaggtcaggagttcaagaccaacctggccaatgtggtgaaatcccatctctactaaaaatacaaaaattagccgggtgttgttgtggcacgcgcctgtagtcccagctactcgggagtctgaggcaggagaatcgcttgaacccaggaggcagaacttgcagtgagccaagatccagccactgcactacagcctgggcgacagagtgaggcttcgtctcaaaaaaaaaaaaaatctttgggccaaatctccagacagcacaggcaggtgcagaaacccaccaggaagctgcctgtgtacctctggcagattggagcctggcctaaagctgccttttatgcagcttgggtcaaggttaaacatcatgtcacagtgatttttctcactatgtgtgagacatggagaactggctccaagtactactctgtccactggtggctggactactgatgtgcaccactctccactcctctcaccctgcagtgggtcatggccccgtgccggggcagaggagaaaaatgggctgccttctccaggacaaaccctcactccaactcaactagggtgctgtgatcagaatgtgcaattgaggtgtgattttactgattttttttttttttgagaccgagtttcgctcttgttgcccaggctggagtgcgatggcacgatctcagttcactgcaacctccacctcccgagtttgagcaattctcctgcctcagcctcctaagtagctgggattacaggcatgtgccaccacgcctggctaattttgtatttttagtagagacggggtttctccatgttggtcaggctggtctcaaactcctgacctcaggtgatccacccgcctcggcctcccaaagtgctagaattacaggcgtgagccaacgtgcccagcctgtttttgttttttgtgttttgaagcagggtctcactcagttccccaggctggagtgcagtgacacgataatagcttactgtagctgcaatctcccgggctcaaacgatcctcccacctcagcctcctgaacagttgggactacaggcacaccaccacacctggctaatttttttttttctttttttagtagagatgaggtcttgctatgttgcccaagctggtctcaaactcctgaggatcaagtgatcctcctaccttagcctcccaaaatgctgggattgcagatgtgagccaccacacccagcctgattttactttaaatgagagtccctcttcagagtccctcagctgttcctggcccctggccatgtgccttcagttgcccctgcttctgtggtatccttaaggctacattcagtgctgaggccctaggcaggcagcagagagaagccaaatgattctgtctttcccttatccacccagagcatgcaaaaccaggagcagtggtgggttcagggtgggcaccagctatgtatatgtacatcagggacagggggccaaaggcagtcagtttccaaagactgccccagaggccatttttcagagaagccctgggttcctcaagggccctgtgtccatgctggcccatcttgcaggacgagcctgtggagtgggagacacctgacctttctcaagctgagattgagcagaagatcaaggagtacaatgcccagatcaacagcaacctcttcatgagcttggtgagttgactgctcaggaagggggcgtggggaggagcaggtacccagctatgtgcctgatactcagagggtcacaactgaggttatcttgggtgggcgcaagcagtaatttgtgcatacccagcctagccccaagtagactgacatctcacctggaacctattatcaaggtttggtttctctatttctttagaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaaggtgggcttcccaccccaccctgccctatgtgagggtatatacgcatgcacctgagcatgcaggggctgagcagctggccctgtctctgatcattacttccccttcacagtgtacttgcggaagctgttggatgatgagcagcccctgcggctgcggctcctggcagggcccagtgacaaggccctgagctttgtcctgaaggaaaatgactctggggaggtgaacgtgagtacatagttcttagtttcttggttgtcactagacaggactgatgggctgtagctacagtaaggcttggaggaggaattgtgctggaagacaagccctgcaaaacagttccaggagtgtataggcattgtaactaaagcaaaggcttccagaccactcatgccaaagcctagggttgtcccaagaagccaggaagaattgccttggtgctttgatctttcctggtgtggaaaatcttctggagatgcaggagtccatctaatgacatgaggaggcccccttcagactttttacctggaagctttctggctccaaggtattaggcctgtggagtgaaattagactcagaatatgcctgacctgtccacaggtaattggggaacatctgacttggttgtctcagtaaggtgaccgttttgtagggcccatcttccatacaaactgctgtcagggatcctaccagagatcattcagccaagagcctgacatcagaaagcccagtcctagcttgtgtgaacatgaggtgctagtcttctctggggagggtctgctggcttggccatcccttctgcagcctgtacactccccttttgccccttgcagtgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcctgctgttggaatcttttatacatataaagtttttgtagagacatgagtctctctgtgttgcccaggatcctcccaacttggcctcccaaagtgttgggattacaggtgtgagccaccctgcccagcctggactctttattattataggcgcagagctgcagttgcccctcatggtgccagaagttgccaagggtgatggacaggctcccaggtgtcttgcaaagtcaccatggaccaatttgtgaagatgtagtatgcatacatacttggtcatcactcagctccctggggctcaggttgtggtggagacaaaaatggactgcagttagaacttagggaaactggctgggcatagtggctcacacctgtaatcccaacactttggttgggctaggtgggcagatcacttgaggccaggagttcgaggccagcctggccagcatggcgaaaccccatctctaccaaaaatacaaaaaaaatttagctgggcgtggtggtgggcgcttgtagtcccagctactcagaaggctgaggcaggagaatcgcttgaacccggcaggcagaggttgcagtgagtggagatcacaccactgcactccgatagagcaagactccaactcaaaaaaaaaaaaaacggccgggcgcagtggctcaggcctgtaatcccagcactttgggaggccaaggcgggtggatcacctgaggtccggagttcaagactgcctgaccaacatggtgaaaccccgtctctactagaaatacaaaaaaattagccggcatggtggcagatgcctgtaatcccaagtactcgggaggctgaggcaggagaatcgcttgaaccctggaggcagaggctgcagtgagccgagatcgtgccactgcacattatcctgggcgacaagagtgaaactccatctcaaaaaaaaaaaaaaacaaaaccatcccttcaacacacacacaccacgctctgggagaaggtgtggcataactccttcaccaaatacagagctgccaccgtggaccagacactgctcgtgataccgagggtatagctgttaacaattcttgctttcattaagcatggactctgctgggtttgaaaacactgaattcgaagttcttcagaactgaatgtaactatgtgaatctggccagttccttaattttctttcaacttggttagttcacataagcgtggcaatcgcaaaaatacagctgtgaaaatagaagccagatgggcacccggcggtctggccttaggccctgaagtgcaggtttgaggattggtgcttgcgaagtcctgctaggcctgaactcaggtgttgggggacgtcagagccgccaaatacacccaaaagaccgggaggactcacggccaccactttcctcggtgggagctgtcccagctggtcagatcgcgcttgctgggacctgggatctcgcaacgcatgctgggatgcccagcatctaagggcgcccattggtcccgcccccacgacttgagcaacagccaatcagaggtggcagcgtgcggaagcggaagtgaggtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcgggtaagggcatgggttccaccctggcggggggaacaggcgggcggccaggcgtcccgcgccacgggggaacttccaccgctgtaccccactacagccaagccaggacgacccccatattttgagcctcattggagctgggggtggagaaagccgggcagtggtctcctg

SEQ ID NO: 14 - DNA, 20911 bp, Homo sapiens
  TBX3
agggatctccaggctgtcatggttgctgggaaagatgagggagggaaagggggcagagtacggaggcaccaggtcagaaagacaggagagaattcagacaggaccaaaacagccagaaaaaataggataaagaaggtagaaaaaaaaaaaaaacaaaacaaaacatgagaagttaaagcctgggaaatagatacaagacaagaaagagaaatagaaaccaagaacaagattgatgaaaggaggagaagagaaagtagaaggaaaaagaataagaaagattccagacacgcattcaaataatcctaaatggggatgagcagaaagacaaggagaccaaaagaaaagggggggggggggtggtggggaggagaaagaaaggaatggaaaaagaaacaaaaggtgaatgtcctgccctgtctgtctggtccaaccaagaagctagtgtctgccctggagggaggaaaggtgggggagtccagcctgtctccaagggactgacaggcagcttctggaccagagaggaactaagctctcaaagcaagctttggggaggaggaagggatgggggtgcatggtgagtggagactcctggaggaagagcaagcctccactgggttcagcactgccagggggagagtcagggttcagggtagcatagcagtgctaatgtatgtaccccagaggggtagggggtgctagggcaatttgcaggaggaccacaaacagtaaactagagagctacttccctgggatccgtgataagaaaatcacttcctcaggtgggagaattgagcccgaaagagaatgggagcccttggggggcaggcacctggtcagtttcaaagctcgtcaatatcaaaagaggctgggatcctgagatcaaatgggctggggcactgggcagaaacgaggagccattgccaaactgccaggatgaccagaacgcccctcccccaggaaaagttcatatatgaacccacccctgtatgaaacttcttaattaggtctcatacccccggtgaatcttggatgcccttctgtcaacagaattcccaatttagtgacacctcggactgaaaagagctctgcggcaaacgggggtgaaagtttaagagggaataagcatataatactcccttgccagacctcacacatgctgaagggaatatttacagcaaactggccaaagcaaacgaccccgcctacccaccatccttttaccctcctccccgccctttttgtaaactccagataaacaccatttgatcacaaaagggtcggtttgtcccctttatagtttgaggcaggcagtgcggcagggaaaagtggcgtgggctaagcttccgtctcgggcaaggccagcttctttgctggcaccgtggcctgggctaaggacagttgatttggttttgtttcccccgacccccaccccgaccccacccccacaaaggaacattattttcagggtcctccccccacccagctttaacactcgcctacttgcacccgcactactttaaatgctgcgggcattgcagatagagaggtttttcagttaatttacttttttaattctagagctacaattaagtgaaaactctttttgcgaaaaggtggaggaatatttcagagacgccagaaattatctgggtcttttctgacccggaatctgccctctttctcccttctcctccccttaagtcacccttttctgggactctgttgaagggcaggctctttcaacgtctctagtctgtcttttgttgagtgtgagaccgaaggaaagaggatcgaggggtctgcagagagaaaaagaccgcagatagccggcagctggcgcctaatgccggggtccggggagcgctggcctcgtgggttctcctggaggccaggcccagcacaagccttcggaacacgctggccaatgtttaacccgaatgcagtggccaccaggccgcttttgtttgttcgcaaattaatcacccagcgcatggccggcgccagagtgggtttatcacccaccgggaggggggcgcgccgggcacgcagagacaaagaggagttcgcaccttcccgcttttgatcccagaattacggcggcctccctgcctaatacgagcctcctggggccgagtctgggaggtcagtcataattggcggaagtttgcagaccattagcaagatgtcgacattttcgattcgaaccccgcaaactttcctctcgttctctgcttcgcgcgctggaggttggtgtgggagaggagatgggggtcagaagtagcgatctggggtgatcacagggttaagttagagctatgggcaaaaaataggcaattgagggaggaggacagtgtgaggggcagaactccctctcagtccacccgcggagccaaaaacaaatctagacatttttaagtaaaatccgcaagctcccctcccatttccaaagctgacagctggccagaatgcagaggaatgtctctctgctgtgcgtgggacgcttgggggcaccgagtgggtgaggaggaggtcggtcacagtgtggttgtagaactactttgcttccaccccaagtagtggggcagagattggcctgcgagggcaggcaggcaaaaccagatcgctgggatttggggccgctcttgaaagagcagcgaaggggccccaggccccggaggcgagcagtctgggggagggggtgcactttttttttctatttctttcttttcttttctttttcttttttttggggcgggggtccccagagactcatgaaaccctgcagtgacttccgtgttctgtgtaaggcgggaaatggcctggcctttcgcacccttcaggtggggaggaggggatgcgggagggggtgttatgagccaacactctggggcaccaccacctcgtaattttccctctctctcctttctctattttaaccactggcagagacagagaggacgccagagaaagacagactgaaagggaaagaaaggggcgagatggcgagccagacggagttcgcagaaccacactattctctctggtgacttcagggaattctcaacgctggcgccaagctctcttaaccatgtgcgtcaaaaatgcgaggctggagaagcctgtcgcctcaaaagatcctcccctatctcagcgtggttggcccacaagagcacttcattttcacccttcccttggtgccacgttggggtttcggggttgctgggggttgcgcgggtgcacaaggcaaaatgcgagagaggcctgtgctggcctacagagacacacacatccaaagccctgagtctcttaaacccctaagcccccagatcagccctttctccgttccctttccatcgaagaagctttcatctcaggaaagataaaagaacattgttttcaagatttccctccatctaagcaaggatggtccaagacattggcccccagaatcaagaactgtgggcttaggcgaatcctctgaccccgaccgggcgctgcggtaacagagttggtaattcggcgattggtaagatccggtcgtttccctcccgtccgcctaagaggaggcccccaccctacccgtactaaaaacagtcaactcgcctctgaggtgggggcgtttcacggtttgttttacaaattcaccctccctccccgacttctggccagattaagtccccggggtggagaaagaactgaggcaccgagagataagtgcgatgcctagagaagataccaggctggcgcgcctcccccaacccaatcgcccaccccttaccctgtgctgtgcacccagccgggcctcgaggtgagggcagcggcttggaggggacaggctcagaacccagtctctcgctgtgctcgctttgtccagatcctccattctcttctctacacccacacccacatccaggtggaatatgggggcccgcatgcaaatgaaagacgagatccaaaagggctggtaaatgcatttcataaaaatcccaaatccatcttccccaggagctcaggcagggccagccgcgcaggctgtgtacgtgtttgtgtgtacgtgtttttcggtgtgtgtttcagtcccagtgtgttggcgcgtgttcgagtacagatacaccgggggtgtttgggtacccgcacatggctgcgggtggggcgcagtggagaggaagcccacacatgcgtgtgctgagatatggccgcatccttgtgctcccccagcccagacgcaggggagaccagcaccgagacacccgagctcgggagcccttcagcggcggccgggcggagcttggctccacgtggggctggagagcacgcaagcctggagtctcggcgctcgcttctcggctgccgccggcttttgtagaaccgagtggccggatggcagctcgcggggaggctcggccacccgcccggctcgcccggggcggggagaagaaggagagctggagagagaaccggccgcggcggtcggagaggcgagcggagtgcaagagaggcgagcgcccctgcccggcgcccgggcgcgctctccgccttccccgcccggctcgcctgctcgctggctccctccctctctccctcccccttcctccttggccctgcctcctccctcgatccccggctggatgactgaggcatttcagacgtgggctgaaccagagcgagcgagcgagctcaggggctgcagcgatctctcgataagccacctagaggcgactctgtgcgcgcgcgctccccagtggctcccgcccgccctctgatcatgttgacatattcacaggacaggcagtagtaccgatgcggcgctgcgacgttacagtttccgacaccttctttttataactcagctctatcccccagcactcgacctgtgaaaaccacgcctatgcagcaacacaattggtccgaaagcgtcaaagagccaatcaagaggcctccggctccccgcagcccacagcgcagcccgaccttctagagccgccgagcagacgcccggtgaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggtaagcagtgggggcctcctcccctaagctgttggagagttttttcctccctttatttctctgctcccagaacagtcggttggtcggttattacggcttggacgaaaagttagttcccctagaaatgtatgcacagacttccaggccctgccccggtggcaggaaatttcagcttacctgggcatctgcatgggtcttgcatttggtctgcatcctgggttccctcccgaacagacagaatttttcagtggagcacagacatccctgcagggagcaggaaagaaaaaaaaaaaaggcactctactgcaagaaactcactcttcaaaccctcctggaacatccttatttctttgttgatgttgtgttgtctgttttattttgttctcagagagaaaaacttaaagccctttccttttgtgtgggtattgggaggcctgacaccattccccggccctttctgccctccagtctagcctctgggtctaaaggggcctgctgctgccctggtcagagagaaatcgaagggcattttggtttgtttgcccacactacttcacgtgtctgtaacccaagggcgagttcagcaggcaattttgcataatttaagattatgtttgcagacttaaggagccagtgaggagacacacaccttttttttaatgtgtgaatattatcaaccatattttacataatgtttaaaggtccttgcctgaccaaaacctgcctggaagagaagatcctgtaatagtcatttaaaatcactgattttttttttgtaatagcattgaagcctgtaaaggcataaagttgatacaaaaataaaatccccttcatgatatcttaagcgttctgtctccttccaagctaaatgaggccaaagtttggcataaaatcctcctcaaactcacaagacatttagtcagttttccagcaaagtgcttccttgcttccttttaagtcaagactacagaatgccaacccttctgtgaaattaacagcaatgtggtggcacagtcttgcggttttggactggcctaagaagtgggggaatgtgttagcagctccacgggcagatcggttatcaggcccaggagtgcaccgaagtctgcaaaattcgttctgggaactcactgaagtccagtttcacttcgcccacagcgggattgctattctgcagcagggaggggtgcaacttgacgttcatttccttgataagtttaacattttctcatcaatgggtggtggaaaattctagtcttaactgaccgcgctttacaaaaatcttaccccaacctgtttagatctagatacccacagaaaaagacatgggcaagaatttgctctcaggagggcaatctgtaaagtcaagcaaggacaaaaaaaatattgaagaaattgttagacaatgtagagaattgcagtgccacaatgcatttgttttgaaccttgggacgtctaaatatggcgaaactgagaatatttaatacgttagttgtggaagaaaacgattttgcaaccagttgcctcactctgaaacatgtaagcttatcagtcacaatataaagtcttagacttggtttcaatattatgtgatacataggaaatcaaacccaagattacgggtggtttatctttctttttcttttctattctttcgttttataggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttgtaagtttcattgctctcttcagtaaaattttctcctccttcactcagtcaaaggcagtgcttcccatttcatgagtttcagcccagacttctcctttgcttctccctaagcatagcaaacttgtcctcgtctggaaaaaggattcggggtgtttctctccaaataatggaaggcctggcgttctaaaagaaatggggcaagaaaacttaccggcttgtgttctatagcaattccagctctttggtagattcctgacctgagagtgaagttaaaaaccattttttaagagctaaaatcaatttcaaggctatgtattcctaaaggatttgttttgttttaaaatatcatacttctgttttgaaaccagtgatattattttctcaggagagtttacgtttcggagccttgactctgttggttaaatggtgtgaatacatttttaaaaactcgttcttttactaaaaaaagaattgggcttaggtgggagtccggcttaccctaaatgaggcttagatcttcagaaaaaaatggtttgtgtgttgggagtgtatatatggattcagtgacagtgcttagaaacttagaaaactttcattgcttgtagatatcaggcaaaggaccttttgcgccttttcctacccctccccaacatttcaataaaataaacagcgtgataagcaaggagtaagcagaaagattaggcccaggaagacgcgaatggcgcggaaatatcttcagcgggcaggaattgcatttgaagcccttgatttgattaaggcataaatattcctctctagagttcagcctttcagggctttaagtggattgggctcgtcaattagtgggcgcttaaagtactgaatcattttgtaaattaaaatgcatgtttttctctatcttttaagactttggccttcccaagtgatcacgctacgtggcaggggaattatagttttggtactcaggtaggctagggttcaaggtatgaatgatccttagatggtgagggtggggggggccctttggcaactgaggagcaatttggattctccagaagataacatctgtggagcgaaacgtacccagggggtactccaaggaggtgggctcggtacaagcgtggtaccctgcggtggggaagatttcagcctggcaggggtcctaagatcccgtttgttctgctaaatccttgttttatgtatgtctcctcttccctgcccctgcagactatattgaactccatgcacaaataccagccccggttccacattgtaagagccaatgacatcttgaaactcccttatagtacatttcggacatacttgttccccgaaactgaattcatcgctgtgactgcataccagaatgataaggtaaactcaaggggctttcctttttaatggtgatattttgccttccccttaaaagctgctttaagtcaggatgagaaagttacaagagagtggagacgagagtcttgagttgtcttttgtgatttgtggagcatttggggggaaaggacaatgacacctcgaggagacagaaaaacaccttgactaggtaggaacaatgctgagcaaaaaaacgccatactaattttgccacagagaaactcctagaactgctgtcattgatgccacccactcctccccccctcttgggctttgtcctgtctgttttaaggttcatcttcttccccttggggaagaaggatcaagaagtcacattcaaaaggaaccagctaaaaatttaaggcaaaagccatttgggatcctgggaggagaatcctagtagagaccagcttttctcccctagccagaaatcctgagtagctggtctggtttttattaccttttatgctgctgtgttatgatgtgtgtgtgtgtgtgcatgtgtgtgcatgcatgcgtgtggttggaaaaacctaccctgatcacagggtcatattaatcgagttgtctgaggcttttgagttggggtggccaaagtcaccacttcatttgaattccccccctcccccaggcctgaatctggaggttagaaggatccccaaaagggaaagcacctgatatctagagctatggtggcctgaaggtcatgggcacagaaaaagtgacccttactgctgattcaccagttcccagattggctgttagcagttatggggtgggaggagggactgaagacccctgctctgcaatcctggacttcaaagagagtccattttacctgacaacacacttcattttgaactcactgtcattgtcactgtccttgggtcctctgtggacttcatgatggggatgttccagctaaatttctttagtgtgaataccaaaacatgatcttctctccctgtgaaacctgaagtcttcaatagagcaatttattccaagaacatgaatccaaccaagggtccccctttccacctctgagtaactctgtgtatataacttcttcttcccaccaaggggaagggatttgaaagattacacactatagcatttttctcaaagtgcaaaatgcatgtgccctctagacccagaatcctgtgaaatgaagttgttaatgtaataataaaatgtagcatttttgatcagacaaaaaggccatgggccttctccacctaatggccatggcagagcatataaatgaaaacagatgtttccagtggtcattcagtactgtaactgtcaatattgtaatttcctcaaaccaccccccaggcaaagaaaaaaaaaattaaactcactcccgcactcactcccgcacaagggtagtgaaaccccataaatcatttattggattcatggaaaaggagtgtgtgtgtgtgtgtgtgtgtgtgtgtgtgtgtgtgaagggagtatgctataatttatgattaattgcactgtataaaaatcaaaatgaaagcataattttaagatctacaggttttccctcttgatgactttgacaacacttccatgtctaaacccaaactgttggctgcccaaagaaaagaatttctttgaataatttcatccccaaatccctggtttggcctcatataggagatacaagccctgccacagtttccttattatctcctttccctggcatatctatatgacttctgttggcagtcacatctctagacttgttgagttgggaaaaacaccctcaaaacattctagaaaatgagaacaatgtctctgtcttgcttgtgtctcttccaatagataacccagttaaaaatagacaacaacccttttgcaaaaggtttccgggacactggaaatggccgaagagaaaaaaggtgagttgaaacaattatttattagatagtttagaaaaatccctttttttaggatccaactctgaagtgttagaagtgagatgcaggcacttatcctaagagcgggtggaaatcattcactttccccactgctacatgcttgccgctatcagtatacccaggacaagtacttttcctacctccttacctttaaggaaattaactaggctacaccatacttatctctggaagagaagcatcagggataatagattatacagggatgcctattaattcctaattaatttaagttcatcctaggcaggtcccagaaagaaccatgccattgagaaaatacttgggaatttttgcaatcctgtcttccaaataccatcagacagagctggggacttcggaaagatgtatggctctctccctccttcgtggggacatgtatcattttgcattacgtagacagctggagagtatatgaaagagggtctcccctcccccaccccctttcaaagaatttctaaaatccagaaaatcacccccaaatttttaacctatccccttggggcgggcattaaaaaataattgctaacagctaaatatatttttattccaattaatttgttagtaaaacgattacagtaaagtgcagcatgaaataaccacttcctcccaatcttagccaccatccaaaatttgggtatgctggggacagacagcgttgtgtttgcaggattggacacccggttctccctatataaggctggcagtccagctgtctctgactagatccagcctcttctcctgcttttaaataaaatttcacagcccaagcaaatgccttttcctaatgaaaccccatcttgaataaatgcaactgaagcctccttcctttctccctaaccctctgccacactcttcagcccagttagagggtcaaggacaaagcttgggtctatgtggctgccctggggcaagcagatttcagtgaattagcgttgtccctgggcagcaggcagggtgtgaggtatgtgtgtgccgctttggaaagggtaagggaaacaaagaggggaaatgtatgttacattctgtaacctgggtgtgggcttctgccacagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaaggtaaaccatgtcacctttgtgatcactggactccagtccctcgtggcctggaagagttgaagggggatggggcaccaaccagggcacttgccctttaaaagctagaagccttctaaacatccttaaacagaagccagagttcaaaaagggctatcaggtgtgtctccccttccccgctaaggcagtagaaggagagcacagaggcctttctcccagatccttatttggctggtggggaggggaggtgggtgtctgtttgcatactacctcttggcaagcagctttgaaaacttgcttgaagcgcttctctcttttctctctgtctctgtttctttctcctcccattctctccaaccaacagaggctccaactgctgacttttcactgtctttgaactctaggttacaatgtgttggactgggtgggggggaagcaagggactctgccacctggaaccgagaaggtggcctagaaaacatccagctataaagcaacaattgacctgggagaggaggtggagcactggggatctgcggtgggggtagagctgggggaggtgggtgaggagtggacaagatggctcaaatcccccctcagttacctgtgtttaaagagcaagcagtatttatttggaaagacacacacacacacacacacacacacacacacacacacacactctcaacgggaagaaacctgttttttagtgaaataaaatgcaagtcctttatgtcttcaatccatttaagctttaaacataaaataggatccctttttcttttcttctggtggaacacccacagagggtgtggtaaaagcgaaaaaagaatctatgatcgtccccgggctgtgagccatctgtccgacactcatctctctctgcagggactggggcaaatacaaacggttcaactgagtactggtgttgaaggacaggtgtccgttctgccattatcaattcagatgtcagggttcttgccaaacaaatccttccagagtaattcacaaatttgtggaaggtgctgctctctgtcattcactgattttttgatagtaattagaatatgttccagctgtgagttttaatgttactttttacttttaaaaagttaatttgcaatcgaatggggagatgcatgtgaaatctgccactgtaggaactcaaaaaaagaagtaaaattcattaaaataagaagagctactgattaggggattgtccatctaagggaaagtttaaactctgggtaaatactttaaattcataatcgcttattgaattttccagcaatgttgttgggcacgattatccccattttgcagatgacaacactgaggtgcagagaggctaaggggctttccccgggattacacagccactaagccacgagctgggattccaacttgggaactggagttccgttggctcatactggagataacgcccttctgccttggttttttccttcgcctgtggtagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcaggtatggatccttcttcctgcctccaccagtctttccacctttcgtccagtttccctgtcctttgccagcagaccctcacccgatccctttggcctagtagctgtaataatttttactgagccattaccgggttcaaggcttagctcatggagttattatgacttcattctccccattcaccccaaaaatctttaaaatttttccgaagttaaaggctgtttccagcagagtagataggtagtaacaaagataacagctggacacagcacttactttcaggcattcttctaagtgcttgctctgtattgactcatttgacctaacccttcaggggtactattatcacctccactttacagatgaaggcgaagacgcccagagatgttgagtgacttgtccaaggtcacacagcgggtacatggtggagctgagactcaaccccaggctatctgactccagggcctctttgagggtttctgattttagcttcagagctgacatgtctcttaagtgtctcatagccaacccttccccaggaatgggactctaggcctggggaggggaagtgactacttcctgagtaggagttcagtcttgattcctccagcctttcctcccagttcgaagctcttctccccacccccaaccccaagcaggccagcctattcctcgaagggttaatggtttgtgcacacgtgggaaatgtcagaggacagggataagcagggactggggcaggcctggaggcctgtgtgtggctcagacagctgtgctggggggaggtctcaggcggctggaaacaccctgaactcgatgaaaaggttctatgaggttttgcatgctgttgccttttgttttgtctgagcacattcgtctggtctcccttccctgcgccaagaaaccagattggcctccccactccagggaggagggagctgaggaaaggcttggcttctggcatttctcaattcctcccatctcctctgctggcttctccgggagaccctgtcctaggtgggcaggtggttggtacaccaaggactacctgaacagacaaaaccttaagggcacctcaaggcatgatgcagagaactggcccaggccagggtgcctgcatcttaaatgctgcttctgccaattcccagcttagtgcactcctgaactcctgcggcctacctcggcttctcacctggaacaccagtgaatcatgctggacgatttctttgtctctgtttataacaaatgccctttttccctcccccagccccagtttccttttgcttaagatcttcactgtctgttttttttgttttgttttgttttgtttggagaaacttctaggattggggtgggaggatgggggttggggaagaagaaagatttaaaaaattattcctactaatttatgtcctccggcttccccttggttacctctgtggggtaaactgaatctgtatccccatttaacaggtgcaaggagatttcctgggggctgcacacactgtgtgcagcatattgcaggctttcactcatttaatatctacaaagtcctcaataagtatatgaattacttatgatttccctgttttttcttcctataaggaagctgaggcacaagttaatcaaagtctcttggcctagggtgacacagctaagatttgtacctagagatttctgagtgttgacttctctcctgcccccacctatctccccccccaaaaaaaaaaacacaacaacaacaacaacagaacataccagggattcatggcttgcccaatgttggagggggagaagagaggagagggatgagataagctcctcccacccggctgactcgctgtgtgtctcttttctcaccccagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtctttgggccttgtgttaaatgttttttctttgggaacctttcctgaagatggacagtcaggggagggtttagtatcttcttgttctgagtttacccccttcccttcgcctttaaataattaagaccgcccccagcgaaccaaaatgagatgtcactcaagttacaaagctaaaaacaaaagtcccttacttgagcgaagggagccacttcaatctgaaattacttttcctttaaattagggagcaaagcagggagacggaaaggggcctgatgagaatacagaaagaagggtaatttcagatacttttaagttttaatggaaaaagactgatgtgctccctaagtcaggttttcccacccgaatccgaccaaaagtaagctcggcaagtacgaatgtttttcgttttaagctcgccctcagttttgacatcaatctggcgaatccaagtcgaaaataccttcttgcaccagtgtgtttggctcggggaaaaggccagcagaatgccccagcagtccgagcgggcttggctaggcagcaaccctccaggttgtagaagtggacaagacgcaacgcctttccactcggcaaccccccacacagcctgcagtccctggtgcctcaaattgaacccggctggcccaaggcgcccctacgaggccccatccatcccgagttgtgcgtgcaaagcgcggccagctccgcgaaaacttagctgtgtcacgcgagggaggagggaaattatccccgaaaggggaaaggtaattccagggtgcacatttcaccccctccacggcaaaagtcacccaggaggctgacatcctcccctagtctccccttcaaacccgtctccaggctgttcggggagttgccttttgaagttcaatttatctttgaaacattcaataaaaaatgatgaggcactgtcagtcttttggtctcccgacccccagcctcgcctccgaggtgtgtgtctgttggggggcgggggcggcacgggaaggttcgagggttagtccttagcccttttcttgccctgggggccatgacgtgaagacccagctggagcctgcctggcggctgcctccctccccaccccccacccgccaccccctggagcccgccagcccggccccaagtccctgtcaccttcaggcctcttgaatgaccggagaggaggacgccccctcccttccctcatcctgtacttggaagggatcgaggtcgagaccttttggagagcggggcaaagccccttccatctctggccaggcacgtggggacccctacagcctcctctgcgatgtctccgggggtgggagggaagacagacaaccagagtatgttggtgcggagtcgcggggggggggaggggcggggtgcgctgcgggggtggcagggcctgagctgagacgggccctggggacctttgaggctggggctcccccgaggactgggagatttccagggcgcgctccttctgcgcagcggctacagcctgaagggggcagctctggatccagcgacaacgcgcggtgtccgcgcctctgagaaggtggtagttggctggttgcgctctcccgaattggggaaaaaagaactcagcctccaaaagggaagaaatgctttgcttttctcttctttctcagtccaaatttgcttacctcctcccttctctccccccgcccccgatttggggaccctgctcagacttgtgtccagcctctcttactggcgttcctcttttttttttttttttttttttaatctcctgtgtatctcatttgtatattgtgatgttaatgagtaactcctgtagcgctgatgggcggggggtggaggggatgaacggctcgcagtctctctggattttgctgcctattactcacctggcgccggtcgcaatctcgccgcaggctttatggtggctgcggccgccccagaggccactcagggcaggcgccttcgccttttttctgggcttcgagtgccacctatctgtct

SEQ ID NO: 15 - DNA, 305 bp, Homo sapiens
cagcaggcgcgctcccggcgaatctgcctgaatcgccgtgaatgcggtggggtgcagggcaggggctggttttctcagccggtcttggcttttctctttctctcctgctccaccagcagcccctccgcgggtcccatgggctccgcgctcagaacagcccggaaccaggcgccgctcgccgctcgctgggggccacccgcctctccccggaacagcctcccgcgggcctcttggcctcgcactggcgccctcacccacacatcgtccctttatccgctcagacgctgcaaagggccttctgtctc

SEQ ID NO: 16 - DNA, 336 bp, Homo sapiens
gctttggatttatcctcattggctaaatccctcctgaaacatgaaactgaaacaaagccctgaaccccctcaggctgaaaagacaaaccccgcctgaggccgggtcccgctccccacctggagggacccaattctgggcgccttctggcgacggtccctgctagggacgctgcgctctccgagtgcgagttttcgccaaactgataaagcacgcagaaccgcaatccccaaactaacactgaacccggacccgcgatccccaaactgacaagggacccggaacagcgacccccaaaccgacacgggactcgggaaccgctatctccaaagggcagc

SEQ ID NO: 17 - DNA, 139 bp, Homo sapiens
tttccacaacagggagccagcattgaggcgcccagatggcatctgctggaaatcacgggccgctggtgaagcaccacgccttacccgacgtggggaggtgatcccccacctcatcccacccccttctgtctgtctcctt

SEQ ID NO: 18 - DNA, 292 bp, Homo sapiens
gctggacaaggagcgctcactgtagctctgctgtggattgtgttggggcgaagagatgggtaagaggtcaaagtcgtaggattctggcgaccgcctaccaagggattgggtccacagcacagaggtctgatcgcttccttctctgctctgccacctccagacagcagctctaaccagctgcccagcagcaagaggatgcgcacggctttcaccagcacgcagctgctagagctggagcgcgagttcgcttctaatatgtacctgtcccgcctacgtcgcatcgagatcgcga

SEQ ID NO: 19 - DNA, 190 bp, Homo sapiens
tgcctgacactgaccccaggcgcagccaggaggggctttgtgcgggagagggagggggaccccagcttgcctggggtccacgggactctcttcttcctagttcactttcttgctaaggcgaaggtcctgaggcaggacgagggctgaactgcgctgcaatcgtccccacctccagcgaaacccagttgac

SEQ ID NO: 20 - DNA, 706 bp, Homo sapiens
tcggcggagagacctcgaggagagtatggggaaaggaatgaatgctgcggagcgcccctctgggctccacccaagcctcggaggcgggacggtgggctccgtcccgaccccttaggcagctggaccgatacctcctggatcagaccccacaggaagactcgcgtggggcccgatatgtgtacttcaaactctgagcggccaccctcagccaactggccagtggatgcgaatcgtgggccctgaggggcgagggcgctcggaactgcatgcctgtgcacggtgccgggctctccagagtgagggggccgtaaggagatctccaaggaagccgaaaaaagcagccagttgggcttcgggaaagacttttctgcaaaggaagtgatctggtcccagaactccagggttgaccccagtacctgacttctccgggagctgtcagctctcctctgttcttcgggcttggcgcgctcctttcataatggacagacaccagtggccttcaaaaggtctggggtgggggaacggaggaagtggccttgggtgcagaggaagagcagagctcctgccaaagctgaacgcagttagccctacccaagtgcgcgctggctcggcatatgcgctccagagccggcaggacagcccggccctgctcaccccgaggagaaatccaacagcgcagcctcctgcacctccttgccccagagac

SEQ ID NO: 21 - DNA, 325 bp, Homo sapiens
agatcccggtgcatttaaaggccggcgtgatctgcaccacgtacctatctcggattctcagtttcacttcgctggtgtctgccaccatctttaccacatcccggtagctacatttgtctaccgcttgagccaccagcgtctgaaacctggaccggattttgcgcgccgagaggtagccggaggcggtaatgaattccacccagagggacatgctcctcttgcgcccgtcgctcaacttcagcaccgcgcagccgggcagtgagccatcgtccacgaagttgaacacccccatttggttgagataaagcaccacttcaaattcggt

SEQ ID NO: 22 - DNA, 663 bp, Homo sapiens
actatgccttgagggtcaaaacgtctggatttcctgatcgatgctgtcgtcgctgtccacggagctactgtcgccgtcagagcgggaaggcacgttcagggagtagaagcgtgggcttgcagaaagggacctgttgctgccttacatgggggccggcagggtagtcttggaaatgcccaagattgcttccgcgcgcgtcagttcagcggacgtgtctgcctggcacgaggaccgttctacaaactcgttcctggaagccgggctcgctggaggcggagctttggtttccttcgggagcttgtggggaatggtcagcgtctaggcaccccgggcaagggtctgtggccttggtggccactggcttcctctagctgggtgttttcctgtgggtctcgcgcaaggcacttttttgtggcgctgcttgtgctgtgtgcggggtcaggcgtcctctctcctcccggcgctgggccctctggggcaggtccccgttggcctccttgcgtgtttgccgcagctagtacacctggatggcctcctcagtgccgtcgttgctgctggagtctgacgcctcgggcgcctgcgccgcacttgtgacttgctttccccttctcagggcgccagcgctcctcttgaccccgcttttattctgtggtgcttctgaag

SEQ ID NO: 23 - DNA, 1985 bp, Homo sapiens
gcaagtcgggtagctaccgggtgctggagaactccgcaccgcacctgctggacgtggacgcagacagcgggctcctctacaccaagcagcgcatcgaccgcgagtccctgtgccgccacaatgccaagtgccagctgtccctcgaggtgttcgccaacgacaaggagatctgcatgatcaaggtagagatccaggacatcaacgacaacgcgccctccttctcctcggaccagatcgaaatggacatctcggagaacgctgctccgggcacccgcttccccctcaccagcgcacatgaccccgacgccggcgagaatgggctccgcacctacctgctcacgcgcgacgatcacggcctctttggactggacgttaagtcccgcggcgacggcaccaagttcccagaactggtcatccagaaggctctggaccgcgagcaacagaatcaccatacgctcgtgctgactgccctggacggtggcgagcctccacgttccgccaccgtacagatcaacgtgaaggtgattgactccaacgacaacagcccggtcttcgaggcgccatcctacttggtggaactgcccgagaacgctccgctgggtacagtggtcatcgatctgaacgccaccgacgccgatgaaggtcccaatggtgaagtgctctactctttcagcagctacgtgcctgaccgcgtgcgggagctcttctccatcgaccccaagaccggcctaatccgtgtgaagggcaatctggactatgaggaaaacgggatgctggagattgacgtgcaggcccgagacctggggcctaaccctatcccagcccactgcaaagtcacggtcaagctcatcgaccgcaacgacaatgcgccgtccatcggtttcgtctccgtgcgccagggggcgctgagcgaggccgcccctcccggcaccgtcatcgccctggtgcgggtcactgaccgggactctggcaagaacggacagctgcagtgtcgggtcctaggcggaggagggacgggcggcggcgggggcctgggcgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgcacgagaacaacatcccgggagagtacctgggctctgtgctcgcccaggatcccgacctgggccagaacggcaccgtatcctactctatcctgccctcgcacatcggcgacgtgtctatctacacctatgtgtctgtgaatcccacgaacggggccatctacgccctgcgctcctttaacttcgagcagaccaaggcttttgagttcaaggtgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgtcctaggacatgtcgctgccgctcatcgtgactctgagcactatctccatcatcc

SEQ ID NO: 24 - DNA, 213 bp, Homo sapiens
atgcgccctctgcacccctagagccagaagacgctaggtgggctgcgcgctctgccaggcgaaggctggagcgcagacggcaaagccgcgcgtttcagccgtggtcgggtccgcaggacctgggcgtggggacaccaccaggcaggagcagaggcaggactgggacgccaaaagctgagaatcctcgatgcccgcgcgagagccccgtgttat

SEQ ID NO: 25 - DNA, 1558 bp, Homo sapiens
ttctggaaaccgggccccacttgcaggcccggccaccttgggttctggtggccgaagccggagctgtgtttctcgcagactcggggagctacattgtgcgtaggcaattgtttagtttgaaaggaggcacatttcaccacgcagccagcgccctgcatgcaggagaagcccccagggcccagggtcggctggctttagaggccacttaggttgttttaagcacatgtgaaagggcagacagcaggggagcaggatatgggtaagatcttcgggtctcagaacaggggctgcccttgggctgtcccggcgccctgggctctgacactgaagggtggaatggaggaaggaatggagaaaggacggtggaactttcgcttcccctctgggccgccttcccagggtcatgcctgagctgctttgatcccagtgtcgcgcatcttggtccgctacctcccaggcgatagctactgggctcctcgctggcctcactgggggccatcccgggcagtggcctgccctccgaggcccgcgggacccagcccagagctgaggttggagttctccgggccacgttccgggtcgcttaggctcggagatttcccggagaccgtcgtcctccctttctgcttggcactgcggagctccctcggcctctctcctcctctggtccctaaggcccggagtggttggcggtactggggcccgtcgtcatctctgcttctaaggcattcagactgggctccagctgggaccggcagaggaggttctcaaggaaactggtgggaaatatagttttctttcgtctggtcgtttaatttaaatgcaacttcccttggggacattttcctggacgttaaccagaccaccttgagatgtcgttgatgacctagagacccagatgatgcgtcccaggaaagttcactgctgactattgtcactcttggcgttatatctatagatatagacctatgtacatatctccaccctgatctctccgtggacatgaaacccacctaccttgtgaaagccctacgggtgacacatgactactacgtctctgtcccaacaggggctgggcctcccctgcctaatagttgccaggagtttcgcagcccaagtgaataatgtcttatggctgaacgtggccaaggactcctgtgatttaggtcccaggaggagcagagacgtccccgccccgcctgggccctgccgcattcaaagctggaagaaggcgctgatcagagaaggggcttccaggtcctgggttagaacaacaacaaacaaacgaaactccacaacagacacgcctgcccatgaccccacgcaaggacataggaagttctgtcgccttcctgctccgcggatagccgcctgccgtctgctgccaccagaacgcacggacgctcggggtggaggtagtcaatgggcagcaggggacccccagcccccacaagcgcggctccgaggacctggaagcgggtgcctgtcgctctccgcaggctccgctctgcctccaggagcaagatccccaaaagggtctggaagctgtggagaaaac

SEQ ID NO: 26 - DNA, 1264 bp, Homo sapiens
ttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggtaagcgcgggcgcgctgcaggggcaggctgcagccctcggctgccgcacgtcccactggccgcccggcgtccccttccttccccctgttgctgagttggtgctcactttctgccaccgctatgggactccgcgtctccgtgttgggcggcggatgctcctgcggcttcttcggcgggggaaggtgtgcgtctccgccgcctcattgtgtgcacacgcgggagcaccctggctcccgcctcccgctgctctcgcgcccttctaccccttagttgatggctcaggcccggctggccagggagcccgggtcactccggggcggctgcaaggcgcagacggagagccgagccgggcgctcactccgcgttctggttcgggcaaacttggaagaactgcgaccgcagtttgcccagcgccacagtctgagtggcgccttctccactcccgcccttgcgccggcaggggcggtggagagacgcggagggctcccccagcccctctctcccctatccgtccttcgggcgacagagcgcccggcgctcgggccgggggcgggcaaggctgggagggaccctcgccggggacctggcctctggacgccggcgtttcaaggctggtttggggacttcacgggctgcctgtttcagatgtggggcgggctttcccgttagggttcctcagtgcttccccagttgctgttggccactcagggcccggggacaccctgccacccggtctggagccggcctcgtctgccagcgaacagccaactttagcgggtggctcagctggggatt

SEQ ID NO: 27 - DNA, 761 bp, Homo sapiens
cactcagtgtgtgcatatgagagcggagagacagcgacctggaggccatgggtgggggcgggtggtgaagctgccgaagcctacacatacacttagctttgacacttctcgtaggttccaaagacgaagacacggtggcttcagggagacaagtcgcaagggcgacttttccaagcgggagatggtgaagtctttggacgtgtagtgggtaggtgatgatccccgcagccgcctgtaggcccgcagacttcagaaaacaagggccttctgtgagcgctgtgtcctccccggaatccgcggcttaacacattctttccagctgcggggccaggatctccaccccgcgcatccgtggacacacttagggtcgcctttgttttgcgcagtgattcaagttgggtaacccttgctcaacacttgggaaatggggagaatctcccccacccgcaacctcccgcaccccaggttcccaaaatctgaatctgtatcctagagtggaggcagcgtctagaaagcaaagaaacggtgtccaaagaccccggagagttgagtgagcgcagatccgtgacgcctgcggtacgctagggcatccaggctagggtgtgtgtgtgcgggtcggggggcgcacagagaccgcgctggtttaggtggacccgcagtcccgcccgcatctggaacgagctgcttcgcagttccggctcccggcgccccagagaagttcggggagcggtgagcctagccgccgcgcgctcatgtttatt

SEQ ID NO: 28 - DNA, 1198 bp, Homo sapiens
agtcactccaggatcagaggccgcgtcggttctgcttggggcatgggcagagggaggctgctggggccaagccccggctggacgcgagggaagaaactcgtcccaggacccgcacgcccatacctggctgtcccagagctcttccctaggccggcaccttcgctcttcctcttccccaccccctagcccttttgtctctttttcagacggatgttttcagtctcaagtggttttattttccgcacaaaaccctgagatcaagggcagatcacagactgtaccggaggctcgggtttccctggactctgtgctgttctgcgtcccagggttggctaggaaggaaggcctgggccggcgaggtgacgggtctcccgcccaggtcggcaggacggggggaggtgtgtcccggtaggtccctggtgagctcacccgtggcatcggggacccgcgggaacccaccgggcgcccactagagactcgggtcctaccctcccccacactactccaccgaaatgatcggaagggcgcgctaggcctgcttccaagggctcagtgataaaggcctcaaaatcacactccatcaagacttggttgaagctttgggtaggtttgttgttgttgttgttgttgtttgtttgtttgttttagcagacacgtcctggaaagaggtcctcagaacccaaaggttcaataatgatttgtggatggattgattatagtctgatatcgctctggttccacagaaacccggagctccttggcccactgttaccccagcagacctaaatggacggtttctgtttttcactggcagctcagaactggaccggaagaagttcccctccacttcccccctcccgacaccagatcattgctgggtttttattttcgggggaaaaacaacaacaacaacaacaaaaaaaacactaggtccttccagactggatcaggtgatcgggcaaaaaccctcaggctagtccggctgggtgcccgagcatgaaaaggcctccgtggccgtttgaacagggtgttgcaaatgagaacttttgtaagccataaccagggcatcctgagggtctgagttcacggtcaaggctgtgggctactaggtccagcgagtccaggcctcgccccgcccccgagctgccacagccaagatcttcggcagggaattcgagaccagggtcctcccactcct

SEQ ID NO: 29 - DNA, 377 bp, Homo sapiens
tttcgtgccgctgttttcaatgcgctaacgaggcacgttattcttagccgcgtccgggaggggatcacattcctgcgcagttgcgctgctggcggaagtgacttgttttctaacgaccctcgtgacagccagagaatgtccgtttctcggagcgcagcacagcctgtcccatcgagaagcctcgggtgaggggcccggtgggcgcccggaggccgctggagggctgtgggagggacggtggctccccactcccgtggcgaagggcaggcaaaccagaagcctcttttgagagccgtttgggattgagacgagtaagccacagcgagtggttagaagtaggttaggaagaaggggaggtaagaaagccgagtagggtt

SEQ ID NO: 30 - DNA, 256 bp, Homo sapiens
gttcggtggacaagggggcagcgcccacagcaagccggaaagagggaggcgcggggccgcgcttggggcctgccgctgcacgccagcctgggcaaagagctgccaccttctgcgggcgaagcgggtcgggacgcaggacggcagcggggctggaggcagctacgtgggtccacacccccatgccctgcaaggctccttggccctgcttctcctctgtctcggcgggagaggagcagcctcggttttacagaatttc

SEQ ID NO: 31 - DNA, 189 bp, Homo sapiens
tgtgccatttagtgagaggtgttttgggcaaagaatcaatttaactgtgactgaccgacgggcttgactgtattaattctgctaccgaaaaaaaaaaaaaaaaaaaagcaatgagccgcaagccttggactcgcagagctgccggtgcccgtccgagagccccaccagcgcggctcacgcctcagtctc

SEQ ID NO: 32 - DNA, 707 bp, Homo sapiens
agagtcccagttctgcaggccgctccagggctaggggtagagatggtggcaggtggtgcgtcaactctctagggaagaggaacttgcattacaaagacttgtctttctgagctgaagtcaaaacgggggcgtcaagcgcgctccgtttggcggcggtggaggggccgcgcgcccgcgctgtcccagccggagctgccctggctggtgattggaggtttaacgtccggaattcaggcgcttctgcagctcagatttgccggccaaggggcctcagttgcaacttttcaaaatggtgtttctggaaaataacaaattcagactcaactggtgacagcttttggctatagagaatgaaactgcttccctttggcggtggaactcttaaacttcgaagagtgaaagaatacaatgaaataaaatgccataagatcactggatttttcagaaaaaggaagaccccaaattactcccaaaatgaggctttgtaaattcttgttaaaaatctttaaatctcgaatttccccctacaacatctgatgagtgctttaagagcaaacgagcaaatcccacctcgagaatcaacaaacccaagctctggccaaggctctccccgcgttttcttctcgtgacctggggaatgtcccgccccatcgctcacctggctcttgtcatctcgctcatcttgaagtgacccgtggacaatgctg

SEQ ID NO: 33 - DNA, 182 bp, Homo sapiens
agctgccctctgtggccatgagcgggtgtccagccccttccaaggctgcaccggggagacgctggttttctgctcgctgtgaccgaacaaagcccctaagagtcagtgcgcggaacagaagagccggaccccgacgggccgagtcccaacgtgaggcacccggcagagaaaacacgttcacg

SEQ ID NO: 34 - DNA, 179 bp, Homo sapiens
cctcggcagcaccggcatggctggaggccagtacggccaggtgtggcgggagggagcgccgtctggcttgggtcgtccatcctgacaggacgctgcaagggcaggagccccgcgccccgtgtcctgcgcccccgctcgaggacaagccccagccgccggtctccgctgggttccgacag

SEQ ID NO: 35 - DNA, 369 bp, Homo sapiens
ctttaagaggctgtgcaggcagacagacctccaggcccgctaggggatccgcgccatggaggccgcccgggactatgcaggagccctcatcaggcgagtgccccgcgtccccctgattgccgtgcgcttccaatcgccttgcgttcggtggcctcatattcccctgtgcgcctctagtaccgtaccccgctcccttcagccccctgctccccgcattctcttgcgctccgcgaccccgcgcacacacccatccgccccactggtgcccaagccgtccagccgcgcccgcgggcagagcccaatcccgtcccgcgcctcctcaccctcttgcagctgggcacaggtaccaggtgtggctcttgcgaggtg

SEQ ID NO: 36 - DNA, 176 bp, Homo sapiens
agacttgcagaactcgggccccctggaggagacctaaccgccacggtcttggggaggttccggagggcctcggttgtctgcactcccaacaccaagaaacccctgagacgcgaagctgccagcgtgctgccctcagagcagggcgacgcaaagccagcggaccccggggtggcggg

SEQ ID NO: 37 - DNA, 167 bp, Homo sapiens
tgctcggctggggggctcgctccgcactttcggtgccagaaaatgcccagaggagcggggcggccccagagcctcctttcggggcgcgaggcccggcgcgtgtgtacggagtccagtccccccagggagtggggtgcccgcaccttcccctccgcgctcggagccac

SEQ ID NO: 38 - DNA, 1205 bp, Homo sapiens
tcttgcacacctgcttgtagttctgcaccgagatctggtcgttgaggaactgcacgcagagcttggtgacctgggggatgtgcaggatcttgctgaccgacagcacctcctccaccgtgtccagggacagggtcacgttggccgtgtagaggtactcgagcaccaggcgcagcccgatggacgagcagccctgcagcaccaggttgttgatggcccgggggctggtcagcagcttgtcgtcgggggaggaagaaggagtcccgggctcctcctgcggcggcggctgctgctgctgtgacggctgctgctgcggcggctgctgctggtccttgggggcccccaggccgtcctggccgccgacccctcccccgagaggggggtggctggagaagagcgatcggaagtactgcgagcaggaggccagcacggccttgtggcaatggaactgctggccctgggccgtcagggtcacgtcgcaaaacagctgcttcctccacagcaggttgaggccgtgcagcaggttgtcgctgtggctggggtcgaaggtggaggtcctgtccccggatctggacatggcgagctgactcggtgcacctggctttaaaccctcctccaacctggcagacaggggtgggggatgggagggaggggagcagggtggtggagcgggtggggtgtggtcggggtggggaagggtgtggaggggaggggagggcgaagaacaagaatcaaggctcagcttgactccctcctggcgcgctccggaccccgaccctaggaggaaagtccgaagacgctggatccgtgagcgccaccagaagggccctgtctggggtcccggcgccggttctgcgccctgcggctcctctcgccacctcccacacacttcgtccctcactttcctaaaaccaaccacctcagctcggctgttggcagcaacagcagtggcagcagcgacggcaaagtggcggctgaggccgaggcacctcgtgggctcgtgtccatgccgggccagatgaagggaaaggccgggaagtggggagccgggggtgccctgaaagctcagaggcgaccgacggcgaaggttccaggtcaacttgtgcccgaagctttgcttttcgcagttggcccagtttgggggagggggtaggaacaggggcccgaccagcgtgcggggtgtgcgaatcttagctctccaaaagctg

SEQ ID NO: 39 - DNA, 44 bp, Homo sapiens
cctctgtgttagtgccctcgggaatttggttgatggggtgtttg

SEQ ID NO: 40 - DNA, 5002 bp, Homo sapiens
tgatgtcgcacctgaacggcctgcaccacccgggccacactcagtctcacgggccggtgctggcacccagtcgcgagcggccaccctcgtcctcatcgggctcgcaggtggccacgtcgggccagctggaagaaatcaacaccaaagaggtggcccagcgcatcacagcggagctgaagcgctacagtatcccccaggcgatctttgcgcagagggtgctgtgccggtctcaggggactctctccgacctgctccggaatccaaaaccgtggagtaaactcaaatctggcagggagaccttccgcaggatgtggaagtggcttcaggagcccgagttccagcgcatgtccgccttacgcctggcaggtaaggccggggctagccaggggccaggctgctgggaagagggctccgggtccggtgcttgtggcccaagtctgcgcgccgagtcacttctcttgattctttccttctctttcctatacacgtcctctttcttctcgtttttatttcttcttccattttctctttctcttccgctcttcccctactttcccttctcccttttctttttctttcttactctctccttgtccctgagctttcattgaccgacccccccccatttcattcgccctcccctcaatgtgccaacctttgccctatttccgatcttcccaggtactgggaggcgggatgggggtgtgcgttttcctctaggagccctgtctttccaagacccacagaaaccaggacctgcccttattcaaaaccccatgcacttcaagtctcttttagacaacacatttcaattttccgggctgactagtctccctgtgcagaggcagttgagaggctttgctctgcagagggaaaagagctctctactctcccacccaccatataggcaaacttatttggtcattggctgaaggcacagccttgcccccgcggggaaccggcggccaggatacaacagcgctcctggagcccatctctggccttggcgttggcgcagggactttctgaccgggcttgaggggctcgggccagctccaatgtcactacctacagcgagggcagggtgtaaggttgagaaggtcacattcaccgctttgggaggacgtgggagaagagactgaggtggaaagcgctttgccttgctcaccggccgtccttgccccggtcccagcgtttgctgggatttgccaggatttgccggggctccgggagaccctgagcactcgcaggaagaggtgctgagaaattaaaaattcaggttagttaatgcatccctgccgccggctgcaggctccgcctttgcattaagcgggcgctgattgtgcgcgcctggcgaccgcggggaggactggcggcccgcgggaggggacgggtagaggcgcgggttacattgttctggagccggctcggctctttgtgcctcctctagcggccaagctgcgaggtacagccctctattgttctaggagcacagaaacctcctgtgtgggcggcgggtgcgcgagctagagggaaagatgcagtagttactgcgactggcacgcagttgcgcgcttttgtgcgcacggaccccgcgcggtgtgcgtggcgactgcgctgcccctaggagcaagccacgggcccagaggggcaaaatgtccaggtcccccgctgggaaggacacactataccctatggcaagccagggtgggcgacttcccatggatcgggtggaggggggtatctttcaggatcggcgggcggtctaggggaacaattcgtggtggcgatgatttgcatagcgcgggtcttgggatgcgcgcggttccgagccagcctcgcacagctcgcttccggagctgcgagctcaggtttccacccccgatcccccgggctttcctcgcaccgctgagcccagcttgtggggtgcactcgaccaacgcccgacagggctggggaatgtgacaggcagcaggttcacccgggcttggggagggggagtttccgctttgacagcattttcctttgccgtctgctggtggattcctattcccagtcggtaatcgccccgcagtgttgatctaagaaggtaaagaaaactaggtttccctgcaaagagcctcccccaaatcggcggactccggatactttgagtggatttagaaatttatgtaatctttctcctttagtttatttttcatcctctcctacagttttctctgatttgctgttggttcggggcaagataaagcagccagtagagagcgataataatagcggcgggaaatgaactggagactggctgacagttcttaacattttgtcatagatccccccgaatgtcccaggctgtctctggtgggttttagtacccgccggcttcttgggcaccggggaccagaaggaacttggcagctggtcttaggggtacagttaaaggcaggatgacagctattctcctgctcatctcagagcgctgccgccccctcatgccggtcgcgcaaagaacacagcttttaaaaaacacgtgccttctgcccatataggtctgaaagtgatgaggaaagtaatgcttcgcctattagcgagtttcagcttttaaaatgatcccaagcgttgctgagatgagaaagcgtggcatcccgggggtcctcagccccacccgcgcccatggtgcaagtctgcagggacaggcccgggacagcactgcccacgctgctagattttccgcagaggatcgctgaagctgccttcgtgggagacagaatgcctcctccagcgagtggaaaaggcctgctgaggaccccgctttgctcgagcattcaaatgtgtgtctgttttattaccctgggttgaaaagggacaagagctttagcctttttatctggccattttatcagcaactacaagtgtgttgagtggttattattacataggaggcttttcagtttggggtcagtagatcagtctcttcagacactgatgcagaagctgggactggtaagtaggtattatgtgctcggagcgctaggggacaggagcaaatggagaagaaaagcggaggctttctccgcccggagtatcgatcggaatccccgccggtacgccgcagagggccctcgccgttgggccccgggggtttaacaagcccagccgctccgcaggcggctcggccggactctcagaccggtgcctggaagacaccgtccctgcccccctcccgccaaacctgcctcttctctttctctcataggttataggttccctttctctctcattttggccccgcccccgggtcctgccaaacagccaagcaggccggggtttagggggctcagaatgaagaggtctgatttggccagcgccggcaaagctcacccttaggcgaggtcacaacagaggcaggtccttcctgcccagcctgccggtgtagtcacagccaagggtggcacttgaaaggaaaagggagaaaacttcggagaaatttagattgccccaacgttagatttcagagaaattgactccaaatgcacggattcgttcggaaagggcggctaagtggcaggtggttgcaaccccgcccggtcgggccttcgcagaggttccccaagaccagcccttgcagggcggttttcagcaacctgacaagaggcggccaagacaaatttctgcgggttcgagcacacactctcgggcgttgggccccagagacctctaaaccaagcacaaacaagaagggagtgagagaacccaggctagaacttgcacgggcatcccactgaggaaaagcgaggcctcggtggcaggcatgttttcttccgacgcccgaaaatcgagccgagcgcccgactacatttactgcagaggtttccgcctccagtgagcccggatcccccagcggcctgcccggagctggtctccagtccccgccgtagtccgacgcacggccctctcctggcagcaagctcccagcggccagtctgaagccaattctgttcaggcggccgagggcccttagccaacccaccatgatgtcgcctgggccacctgatgcccgcagcggcgggacacggcccgggcagtgcgcagtggctcctgctaggggcaccgcgtgcgtgcttgtctcccgctgcgccggggacgtccttgggtgacacgggccgctgggcacctcccaagccgaggaaacggacccccttcgcagagtctcgcgcccaccccccaacctcccacctcgtttctcgctgctagggctcccgactcagcccacctctcctggcggtttagttagggatcagagctggagaggctgaacgcaacccgtgccagtacggaacagacgatatgtttgcctgctagctgcttggatgaataattgaaaagttcgctgcagtctgtgcttcgtcaagtcccgggtgccgggagaacaccttcccaacacgcatcagggtgggcgggagcgggcagaggaggcgggacccgagggaggagagtgaacccgagcaggagaagcagcccaggcagccaggcgccctcgatgcgagaggctgggcatttatttttattccaggctttccactgtgtggttatgtcactttctcaaacaaatgtgtatatggagggagatcgatgctgataatgtttagaagattaaaagagcattaatgctggcaacaataacgtaaacgtgtggacccagatttcattgatctggaacttgatccggcgcgtttccagtaagcccgacggcgcgctcttcccagcagagcgctcaccagcgccacggccccgcggttttccagcggtgccgcttcgccagctctgcgcgggttctcccgtctgaccgcagctcctcccccgcgaggccccagcccgccttacttccccgaggttttctcctcctctcgcggggctctctgccctctgcaccccctcccccgacctctgcaccacccgcccctgtgcgcacacaccgctacttgcgcttccggcgatccgcctg

SEQ ID NO: 41 - DNA, 150 bp, Homo sapiens
aaccggagatctgcttggtgaactgagaggagtccttaggagagcggggacgccaggggccgggggacacttcgctctcgccctagggaaggtggtcttgacgctttctattgaagtcaaacttgaaaatatcagctgccgctggactat

SEQ ID NO: 42 - DNA, 339 bp, Homo sapiens
cgtgagcagaacgcccgccctggagcagttaggaccgaaggtctccggagagtcgccggcggtgccaggtaacgcagagggctcgggtcgggccccgcttctggggcttgggactccgggcgcgcggagccagccctctggggcgaaatccccgggcggcgtgcgcggtccctctccgcgctgtgctctcccagcaactccctgccacctcgacgagcctaccggccgctccgagttcgacttcctcggacttagtgggagaaggggttggaaatgggctgccgggactgggggagctgctctctggaagcagggaagctggggcgcaccggggcaggt

SEQ ID NO: 43 - DNA, 1961 bp, Homo sapiens
tagaagaggaagactcctctggccccactaggtatcatccgcgctctcccgctttccacctgcgccctcgcttgggccaatctctgccgcacgtgtccatccctgaactgcacgctatcctccacccccggggggttcctgcgcactgaaagaccgttctccggcaggttttgggatccggcgacggctgaccgcgcgccgcccccacgcccggttccacgatgctgcaatacagaaagtttacgtcggccccgacccgcgcgggactgcagggtccgccggagcgcggcgcagaggcttttcctgcgcgttcggccccgggaaaggggcgggagggctggctccgggagcgcacgggcgcggcggggagggtactcactgtgaagcacgctgcgcccatggatcatgtctgtgcgttacaccagaggctccgggctccactaattccatttagagacgggaagacttccagtggcggggggaggacagggtcgagaggtgttaaagacgcaaagcaagaaggaaataaaggggggccgagagggagaccgagaggaagggggagctccgagcccacgctgcagccagatccggatgagtccgtcctccgccccgggcgggctctcgctctcgctggccctcagcgccgcgcagccagcagcatccccaccgtgacgctcgcatcacacccgggcgccggccgccaccatccgcgccgccgccgtcaggaccctcctcccgggcatcgtcgccgccgcggggtcgggaggacgcggcgcgcgggaggcggcggtcgcagggcgagccccgggacgccccgagccggggccggggccggggagagggcgcagcgaggtgggggccagtccagaccgacggcagcgacggagcgggcggcggcggcggcgccggcggcggcggggtggctcagtccccagtctcagacgcgccgcgcagcaggtcggagcagcctccccgggaggatgtccagcggcagcgctcctcgctccagcccttggggatcttccgctgaggcattgaaggcaggaagaaggggtccgtcatcggctcgccgggctgcgcgccacctctgctatcttgcggaaagaggagcgggtgggtgggcgtctgggaggcgggctggagggcggtgcaggggagcggggcggccggggggggggccggggggcggggaagggagggaggagaaaggagccggaagagggcagagttaccaaatgggctccttagtcatggcttggggctccacgaccctcctggaagcccggagcctgggtgggatagcgaggctgcgcgcggccggcgccccggggctggtgcgcggcagaatggggccgcggcggcggcagcaaggacatcccagccgcgcggatctgggggaggggcggggagggggtgaggacccggctgggatccgcggctcggcccgccagggcgcagagagaggatgcagccgcaaatcccgagccggatcctcgtgccggacggaaggcgtggaagcgggaggggccttcgtgtgaaaatcccttgtggggtttggtgtttcactttttaaaggttagaccttgcgggctctctgcctcccaccccttcttttccatccgcgtaaaggaactgggcgccccctctccctccctccctggggcgcaggtttcgccgcggactccgcgctcagcttgggagacacggcaggggcgcgccccagggaaaggcggccgtaaaagtttcgcggttgagcactgggcctgatgtccagtccccccaccaaattactcctgcaaagacgcgggcttcttgcaattgagccccccacctcgaggtatttaaaaccaccccaaggcacacacggacccccgttcccccgcgccacttcctcctacaggctcgcgcggcgcgttaaagtctgggagacacgagttgcggggaaacagcaccggaag

SEQ ID NO: 44 - DNA, 314 bp, Homo sapiens
aagaaacagctcatttcggagctgaggacaaggcgtgggaagaagacgcgtttggtttcacccaggcgggtggcggcaaagctgtgggatgcgcgctgcacactccttccgtcatcccgttcccaccttccacacacacctgcgggaggtcggacatgtcctgattgcgtgttcatcacgatggcaaaccgaacatgaggagaacgccactgacgctgggtgcgccggctttcccagccctcgtgcataacggggagggagatgcagaagttttttccaacatcggtgcaaaggggaagctgaggttttcctat

SEQ ID NO: 45 - DNA, 584 bp, Homo sapiens
tctgtcagctgctgccatggggcagcgggaaggccctggagggtgcctgggctgtgtctggtcccggccacgcgtccctgcagcgtctgagaccttgtggaacacacttgacccggcgctgggacggggtcggcccacacgcaccgccagcccgcaggagtgaggtgcaggctgccgctggctccttaggcctcgacagctctcttgaggtcggccctcctcccctcccgagagctcagcagccgcagacccaggcagagagagcaaaggaggctgtggtggcccccgacgggaacctgggtggccgggggacacaccgaggaactttccgccccccgacgggctctcccaccgaggctcaggtgctcgtgggcagcaaggggaagccccatggccatgccgcttccctttcaccctcagcgacgcgccctcctgtgcccgcggggaacaagacggctctcggcggccatgcaggcggcctgtcccacgaacacgatggagacctcagacgccgtccccaccctgtcactgtcaccatcacccatcctgtcccctcacgcctccccacatcccatcattactac

SEQ ID NO: 46 - DNA, 349 bp, Homo sapiens
gaagtagaatcacagtaaatgaggagttagggaatttagggtagagattaaagtaatgaacagaggaggaggcctgagacagctgcagagagaccctgtgttccctgtgaggtgaagcgtctgctgtcaaagccggttggcgctgagaagaggtaccgggggcagcacccgcctcctgggagagggatgggcctgcgggcacctgggggaaccgcacggacacagacgacactataaacgcgggcgagacatcagggaccgggaaacagaaggacgcgcgtttcgagcagctgcccagtgggccacaagccccgccacgccacagcctcttcccctcagcacgcagaga

SEQ ID NO: 47 - DNA, 3510 bp, Homo sapiens
tactccggcgacgggaggatgttgagggaagcctgccaggtgaagaaggggccagcagcagcacagagcttccgactttgccttccaggctctagactcgcgccatgccaagacgggcccctcgactttcacccctgactcccaactccagccactggaccgagcgcgcaaagaacctgagaccgcttgctctcaccgccgcaagtcggtcgcaggacagacaccagtgggcagcaacaaaaaaagaaaccgggttccgggacacgtgccggcggctggactaacctcagcggctgcaaccaaggagcgcgcacgttgcgcctgctggtgtttattagctacactggcaggcgcacaactccgcgccccgactggtggccccacagcgcgcaccacacatggcctcgctgctgttggcggggtaggcccgaaggaggcatctacaaatgcccgagccctttctgatccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaagtgctagcatccgagatctgcagaaacaaatgtctgaattcgaaatgtatgggtgtgagaaattcagctcggggaagagattagggactgggggagacaggtggctgcctgtactataaggaaccgccaacgccagcatctgtagtccaagcagggctgctctgtaaaggcttagcaattttttctgtaggcttgctgcacacggtctctggcttttcccatctgtaaaatgggtgaatgcatccgtacctcagctacctccgtgaggtgcttctccagttcgggcttaattcctcatcgtcaagagttttcaggtttcagagccagcctgcaatcggtaaaacatgtcccaacgcggtcgcgagtggttccatctcgctgtctggcccacagcgtggagaagccttgcccaggcctgaaacttctctttgcagttccagaaagcaggcgactgggacggaaggctctttgctaaccttttacagcggagccctgcttggactacagatgccagcgttgcccctgccccaaggcgtgtggtgatcacaaagacgacactgaaaatacttactatcatccggctcccctgctaataaatggaggggtgtttaactacaggcacgaccctgcccttgtgctagcgcggttaccgtgcggaaataactcgtccctgtacccacaccatcctcaacctaaaggagagttgtgaattctttcaaaacactcttctggagtccgtcccctccctccttgcccgccctctacccctcaagtccctgcccccagctgggggcgctaccggctgccgtcggagctgcagccacggccatctcctagacgcgcgagtagagcaccaagatagtggggactttgtgcctgggcatcgtttacatttggggcgccaaatgcccacgtgttgatgaaaccagtgagatgggaacaggcggcgggaaaccagacagaggaagagctagggaggagaccccagccccggatcctgggtcgccagggttttccgcgcgcatcccaaaaggtgcggctgcgtggggcatcaggttagtttgttagactctgcagagtctccaaaccatcccatcccccaacctgactctgtggtggccgtattttttacagaaatttgaccacgttccctttctcccttggtcccaagcgcgctcagccctccctccatcccccttgagccgcccttctcctccccctcgcctcctcgggtccctcctccagtccctccccaagaatctcccggccacgggcgcccattggttgtgcgcagggaggaggcgtgtgcccggcctggcgagtttcattgagcggaattagcccggatgacatcagcttcccagccccccggcgggcccagctcattggcgaggcagcccctccaggacacgcacattgttccccgcccccgcccccgccaccgctgccgccgtcgccgctgccaccgggctataaaaaccggccgagcccctaaaggtgcggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctggtgagctccccgtggtctccagatgcagcacatggactctgggccccgcgccggctctgggtgcatgtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataacctgttgcatgagagcagaggggagatagagagagcttaattataggtacccgcgtgcagctaaaaggagggccagagatagtagcgagggggacgaggagccacgggccacctgtgccgggaccccgcgctgtggtactgcggtgcaggcgggagcagcttttctgtctctcactgactcactctctctctctctccctctctctctctctcattctctctcttttctcctcctctcctggaagttttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgccc

SEQ ID NO: 48 - DNA, 333 bp, Homo sapiens
ttaattcgaaaatggcagacagagctgagcgctgccgttcttttcaggattgaaaatgtgccagtgggccaggggcgctgggacccgcggtgcggaagactcggaacaggaagaaatagtggcgcgctgggtgggctgccccgccgcccacgccggttgccgctggtgacagtggctgcccggccaggcacctccgagcagcaggtctgagcgtttttggcgtcccaagcgttccgggccgcgtcttccagagcctctgctcccagcggggtcgctgcggcctggcccgaaggatttgactctttgctgggaggcgcgctgctcagggttctg

SEQ ID NO: 49 - DNA, 385 bp, Homo sapiens
ccggtccccagtttggaaaaaggcgcaagaagcgggcttttcagggaccccggggagaacacgagggctccgacgcgggagaaggattgaagcgtgcagaggcgccccaaattgcgacaatttactgggatccttttgtggggaaaggaggcttagaggctcaagctataggctgtcctagagcaactaggcgagaacctggccccaaactccctccttacgccctggcacaggttcccggcgactggtgttcccaagggagccccctgagcctaccgcccttgcagggggtcgtgctgcggcttctgggtcataaacgccgaggtcgggggtggcggagctgtagaggctgcccgcgcagaaagctccaggatcccaatatgtg

SEQ ID NO: 50 - DNA, 105 bp, Homo sapiens
gcgcaggtccccccagtccccgagggagtgcgcccgacggaaacgcccctagcccgcgggcctcgctttcctctcccgggttcctgggtcacttcccgctgtctc

SEQ ID NO: 51 - DNA, 147 bp, Homo sapiens
ttccctcgcggctttggaaagggggtgcaaatgcacccttctgcgggcccgctacccgctgcaacacctgtgtttcctttctgggcaccttctaggtttctagatattgctgtgaatacggtcctccgctgtacagttgaaaacaaa

SEQ ID NO: 52 - DNA, 365 bp, Homo sapiens
tgggaatttaggtcgggcactgccgatatgtcgccttccacaaggcgggcccgggcctctgctgaccgtgcaccggtcctggggctgggtaattctgcagcagcagcgcagcccatgccggggaatttgcgggcagaggagacagtgaggcccgcgttctgtgcgggaactcccgagctcacagagcccaagaccacacggctgcatctgcttggctgactgggccaggcccacgcgtagtaacccggacgtctctctctcacagtccccttgcgtctggccagggagctgccaggctgcaccccgcggtggggatcgggagaggggcagtgtcgcccatccccggaaggctgagcctggtgcag

SEQ ID NO: 53 - DNA, 418 bp, Homo sapiens
cggttttctcctggaggactgtgttcagacagatactggtttccttatccgcaggtgtgcgcggcgctcgcaagtggtcagcataacgccgggcgaattcggaaagcccgtgcgtccgtggacgacccacttggaaggagttgggagaagtccttgttcccacgcgcggacgcttccctccgtgtgtccttcgagccacaaaaagcccagaccctaacccgctcctttctcccgccgcgtccatgcagaactccgccgttcctgggaggggaagcccgcgaggcgtcgggagaggcacgtcctccgtgagcaaagagctcctccgagcgcgcggcggggacgctgggccgacaggggaccgcgggggcagggcggagaggacccgccctcgagtcggcccagccctaacactcaggac

SEQ ID NO: 54 - DNA, 906 bp, Homo sapiens
agggaatcgggctgaccagtcctaaggtcccacgctcccctgacctcagggcccagagcctcgcattaccccgagcagtgcgttggttactctccctggaaagccgcccccgccggggcaagtgggagttgctgcactgcggtctttggaggcctaggtcgcccagagtaggcggagccctgtatccctcctggagccggcctgcggtgaggtcggtacccagtacttagggagggaggacgcgcttggtgctcagggtaggctgggccgctgctagctcttgatttagtctcatgtccgcctttgtgccggcctctccgatttgtgggtccttccaagaaagagtcctctagggcagctagggtcgtctcttgggtctggcgaggcggcaggccttcttcggacctatccccagaggtgtaacggagactttctccactgcagggcggcctggggcgggcatctgccaggcgagggagctgccctgccgccgagattgtggggaaacggcgtggaagacaccccatcggagggcacccaatctgcctctgcactcgattccatcctgcaacccaggagaaaccatttccgagttccagccgcagaggcacccgcggagttgccaaaagagactcccgcgaggtcgctcggaaccttgaccctgacacctggacgcgaggtctttcaggaccagtctcggctcggtagcctggtccccgaccaccgcgaccaggagttccttcttcccttcctgctcaccagccggccgccggcagcggctccaggaaggagcaccaacccgcgctgggggcggaggttcaggcggcaggaatggagaggctgatcctcctctagccccggcgcattcacttaggtgcgggagccctgaggttcagcctgactttc

SEQ ID NO: 55 - DNA, 860 bp, Homo sapiens
cactacggatctgcctggactggttcagatgcgtcgtttaaaggggggggctggcactccagagaggagggggcgctgcaggttaattgatagccacggaagcacctaggcgccccatgcgcggagccggagccgccagctcagtctgacccctgtcttttctctcctcttccctctcccacccctcactccgggaaagcgagggccgaggtaggggcagatagatcaccagacaggcggagaaggacaggagtacagatggagggaccaggacacagaatgcaaaagactggcaggtgagaagaagggagaaacagagggagagagaaagggagaaacagagcagaggcggccgccggcccggccgccctgagtccgatttccctccttccctgacccttcagtttcactgcaaatccacagaagcaggtttgcgagctcgaatacctttgctccactgccacacgcagcaccgggactgggcgtctggagcttaagtctgggggtctgagcctgggaccggcaaatccgcgcagcgcatcgcgcccagtctcggagactgcaaccaccgccaaggagtacgcgcggcaggaaacttctgcggcccaatttcttccccagctttggcatctccgaaggcacgtacccgccctcggcacaagctctctcgtcttccacttcgacctcgaggtggagaaagaggctggcaagggctgtgcgcgtcgctggtgtggggagggcagcaggctgcccctccccgcttctgcagcgagttttcccagccaggaaaagggagggagctgtttcaggaatttcagtgccttcacctagcgactgacacaagtcgtgtgtataggaag

SEQ ID NO: 56 - DNA, 452 bp, Homo sapiens
ggagcctgaagtcagaaaagatggggcctcgttactcactttctagcccagcccctggccctgggtcccgcagagccgtcatcgcaggctcctgcccagcctctggggtcgggtgagcaaggtgttctcttcggaagcgggaagggctgcgggtcggggacgtcccttggctgccacccctgattctgcatccttttcgctcgaatccctgcgctaggcatcctccccgatcccccaaaagcccaagcactgggtctgggttgaggaagggaacgggtgcccaggccggacagaggctgaaaggaggcctcaaggttcctctttgctacaaagtggagaagttgctctactctggagggcagtggccttttccaaacttttccacttaggtccgtaagaaaagcaattcatacacgatcagcgctttcggtgcgaggatggaaagaaacttc

SEQ ID NO: 57 - DNA, 1992 bp, Homo sapiens
ttttcctgttacagagctgagcccactcatgtggtgccaagtagcgactatctctcggccacctccacccagagcaatgtgggcgcccccagcgggtgggagcgattgccgagcggcgcaagggcgtttaacgcctaaccccctcctcctgggttgccaagccgctaggtcgccgtttccaacgtggctgcgcgggactgaagtccgacgactcctcgtcctcagtaggagacacacctcccactgcccccagccacgcgagctatgggcagaatcggggcaacggtaatatctggatggggcaggctcccctgaggctgtgcttaagaaaaaaggaatctggagtagcctgaggggccccacgagggggcctcctttgcgatcgtctcccagccttaggccaaggctacggaggcaggcggccgagtgttggcgcccagcccggccgaggactggatggaggacgagaagcagcctgcctctgggcgacagctgcggacgcagcctcgccgcctcgccgcctcagcctcggtcccagcgtctctaaagccgcgcccattttacagatgcagggcagggagacaagaggcatctccgggggccgagtagaatgatggcgcgggttctcccggcgccctgatttcgaggctgcgcccggggccctacatgcaggcggggaggcctgggccgaaggcgtctgcaaggaggggcgagtctgcccggtccgggcagggagtgaggccacagtcagttctccctaggaggccgcgcagcgggtagggtatgggactgggggacgcaacggggacctggccgaatcagagccctcagcagagaacgccgaaaactctggggccggccgctcgcttcccgctagtgggaatggtttccggtcatccgttcccagtccagccccgggtagggagctctgatttgcaatgcacagcacttgcgaggttcgaatgcccccgcaatttgcagatggaaatactaagcctaggccgggcgtggtggctcaagcctatcatctcagccctttgggaggccaagccgggaggattgtttgagcccaagaattcaaaaccagcctgagcaacatagcgaccccgtctctacaaaataaaataaaataaattatccgggcgtggtggcacgcgcctgtggttccagctactccggaggctgaggtgggaggatcgcttgagtccgggaggtcgaggctacagtgagccgtgatcgcaccactgcactccagcctgggcgacagagtgagaccttgtctcaaaaaaggaaaaaaagaaaaagaaagtaagcttcaaagaagctctgataatagttctgggtcgtgcagcggtggcggccccgcgctctcgcccctaaagcaagcgctctttgtactgggtggaggagctttgagtagtgagggtggagatgcagcttcggggtggcgcagccaccctgacactaggcccggggtcgcagtgggacagaagagtctgccgctctgacttgggctctgagttccaagggcgcccggcacttctagcctcccaggcttgcgcgctggcgcctttgccatccgtgccgaagtggggagacctagccgcgaccaccacgagcgcagcggtgacacccagaggtcccaccgggcccctgggcagggtaaccttagcctgtccgcttcggcagctttgcgaagagtggcgcgcagctagggctgaggctcttgcggacctgcggtcgaagcaggcggctgagccagttcgatcgccaaggcctgggctgccgacagtggtgcgcgctctgttccgccgcggccgggccaggcgctctggaatagcgatggggggacacggcctccaactttctgcagagaccatcgggcagctccgggcctaagcagcgacctcaccgaaggttcctgggaacctttgccaaaatcccagcctctgcctcggtccagctaaaccgtgtgtaaacaagtgcaccaag

SEQ ID NO: 58 - DNA, 448 bp, Homo sapiens
ataaaggaccgggtaatttcgcggaatgcggattttgagacaggcccagacggcggcggattccctgtgtcccccaactggggcgatctcgtgaacacacctgcgtcccaccccgatcctaggttggggggaaagggtatgggaaccctgagcccagagcgcgccccgctctttcctttgctccccggcttccctggccagccccctcccggctggtttcctcgctcactcggcgcctggcgtttcgggcgtctggagatcaccgcgtgtctggcaccccaacgtctagtctccccgcaggttgaccgcggcgcctggagccgggaataggggtggggagtccggagaaccaaacccgagcctgaagttgccattcgggtgactcccgagaaagcccgggagcattttggccaatgcgggtttttacctgaacttcagcatcttcacc

SEQ ID NO: 59 - DNA, 395 bp, Homo sapiens
aattggaaaaccctggtattgtgcctgtttgggggaagaaaacgtcaataaaaattaattgatgagttggcagggcgggcggtgcgggttcgcggcgaggcgcagggtgtcatggcaaatgttacggctcagattaagcgattgttaattaaaaagcgacggtaattaatactcgctacgccatatgggcccgtgaaaaggcacaaaaggtttctccgcatgtggggttccccttctcttttctccttccacaaaagcaccccagcccgtgggtcccccctttggccccaaggtaggtggaactcgtcacttccggccagggaggggatggggcggtctccggcgagttccaagggcgtccctcgttgcgcactcgcccgcccaggttctttgaa

SEQ ID NO: 60 - DNA, 491 bp, Homo sapiens
gggaagcgatcgtctcctctgtcaactcgcgcctgggcacttagcccctcccgtttcagggcgccgcctccccggatggcaaacactataaagtggcggcgaataaggttcctcctgctgctctcggtttagtccaagatcagcgatatcacgcgtcccccggagcatcgcgtgcaggagccatggcgcgggagctataccacgaagagttcgcccgggcgggcaagcaggcggggctgcaggtctggaggattgagaagctggagctggtgcccgtgccccagagcgctcacggcgacttctacgtcggggatgcctacctggtgctgcacacggccaagacgagccgaggcttcacctaccacctgcacttctggctcggtaagggacggcgggcggcgggaccccgacgcaccaaggccggcgaggggagggcgtaggggtctgagatttgcaggcgtgggagtaaaggggaccgcaaactgagctag

SEQ ID NO: 61 - DNA, 1284 bp, Homo sapiens
ctcaggggcgggaagtggcgggtgggagtcacccaagcgtgactgcccgaggcccctcctgccgcggcgaggaagctccataaaagccctgtcgcgacccgctctctgcaccccatccgctggctctcacccctcggagacgctcgcccgacagcatagtacttgccgcccagccacgcccgcgcgccagccaccgtgagtgctacgacccgtctgtctaggggtgggagcgaacggggcgcccgcgaacttgctagagacgcagcctcccgctctgtggagccctggggccctgggatgatcgcgctccactccccagcggactatgccggctccgcgccccgacgcggaccagccctcttggcggctaaattccacttgttcctctgctcccctctgattgtccacggcccttctcccgggcccttcccgctgggcggttcttctgagttaccttttagcagatatggagggagaacccgggaccgctatcccaaggcagctggcggtctccctgcgggtcgccgccttgaggcccaggaagcggtgcgcggtaggaaggtttccccggcagcgccatcgagtgaggaatccctggagctctagagccccgcgccctgccacctccctggattcttgggctccaaatctctttggagcaattctggcccagggagcaattctctttccccttccccaccgcagtcgtcaccccgaggtgatctctgctgtcagcgttgatcccctgaagctaggcagaccagaagtaacagagaagaaacttttcttcccagacaagagtttgggcaagaagggagaaaagtgacccagcaggaagaacttccaattcggttttgaatgctaaactggcggggcccccaccttgcactctcgccgcgcgcttcttggtccctgagacttcgaacgaagttgcgcgaagttttcaggtggagcagaggggcaggtcccgaccggacggcgcccggagcccgcaaggtggtgctagccactcctgggttctctctgcgggactgggacgagagcggattgggggtcgcgtgtggtagcaggaggaggagcgcggggggcagaggagggaggtgctgcgcgtgggtgctctgaatccccaagcccgtccgttgagccttctgtgcctgcagatgctaggtaacaagcgactggggctgtccggactgaccctcgccctgtccctgctcgtgtgcctgggtgcgctggccgaggcgtacccctccaagccggacaacccgggcgaggacgcaccag

SEQ ID NO: 62 - DNA, 554 bp, Homo sapiens
tggagaaccttgggctctgtggcctcaaaggtaggggtgatttcgaggggccggcacctcacagggcaggttccaccgcggaaacgcagtcatcgcccagcgaccctgctcctggccctcagcctccccccaggtttctttttctcttgaatcaagccgaggtgcgccaatggccttccttgggtcggatccggggggccagggccagcttacctgctttcaccgagcagtggatatgtgccttggactcgtagtacacccagtcgaagccggcctccaccgccaggcgggccagcatgccgtacttgctgcggtcgcggtcagacgtggtgatgtccactgcgcggccctcgtagtgcagagactcctctgagtggtggccatcttcgtcccagccctcggtcacccgcagtttcactcctggccactggttcatcaccgagatggccaaagcgttcaacttgtccttacacctctgcgaagacaaggggacccccaccgacggacacgttagcctgggcaaccgccacccctcccggcccctccatcagcct

SEQ ID NO: 63 - DNA, 772 bp, Homo sapiens
tctcacgacccatccgttaacccaccgttcccaggagctccgaggcgcagcggcgacagaggttcgccccggcctgctagcattggcattgcggttgactgagcttcgcctaacaggcttggggagggtgggctgggctgggctgggctgggctgggtgctgcccggctgtccgcctttcgttttcctgggaccgaggagtcttccgctccgtatctgcctagagtctgaatccgactttctttcctttgggcacgcgctcgccagtggagcacttcttgttctggccccgggctgatctgcacgcggacttgagcaggtgccaaggtgccacgcagtcccctcacggctttcggggggtcttggagtcgggtggggagggagacttaggtgtggtaacctgcgcaggtgccaaagggcagaaggagcagccttggattatagtcacggtctctccctctcttccctgccatttttagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaat

SEQ ID NO: 64 - DNA, 1362 bp, Homo sapiens
tggtttcctttcgcttctcgcctcccaaacacctccagcaagtcggagggcgcgaacgcggagccagaaacccttccccaaagtttctcccgccaggtacctaattgaatcatccataggatgacaaatcagccagggccaagatttccagacacttgagtgacttcccggtccccgaggtgacttgtcagctccagtgagtaacttggaactgtcgctcggggcaaggtgtgtgtctaggagagagccggcggctcactcacgctttccagagagcgacccgggccgacttcaaaatacacacagggtcatttatagggactggagccgcgcgcaggacaacgtctccgagactgagacattttccaaacagtgctgacattttgtcgggccccataaaaaatgtaaacgcgaggtgacgaacccggcggggagggttcgtgtctggctgtgtctgcgtcctggcggcgtgggaggttatagttccagacctggcggctgcggatcgccgggccggtacccgcgaggagtgtaggtaccctcagcccgaccacctcccgcaatcatggggacaccggcttggatgagacacaggcgtggaaaacagccttcgtgaaactccacaaacacgtggaacttgaaaagacaactacagccccgcgtgtgcgcgagagacctcacgtcaccccatcagttcccacttcgccaaagtttcccttcagtggggactccagagtggtgcgccccatgcccgtgcgtcctgtaacgtgccctgattgtgtacccctctgcccgctctacttgaaatgaaaacacaaaaactgttccgaattagcgcaactttaaagccccgttatctgtcttctacactgggcgctcttaggccactgacagaaacatggtttgaaccctaattgttgctatcagtctcagtcagcgcaggtctctcagtgacctgtgacgccgggagttgaggtgcgcgtatccttaaacccgcgcgaacgccaccggctcagcgtagaaaactatttgtaatccctagtttgcgtctctgagctttaactcccccacactctcaagcgcccggtttctcctcgtctctcgcctgcgagcaaagttcctatggcatccacttaccaggtaaccgggatttccacaacaaagcccggcgtgcgggtcccttcccccggccggccagcgcgagtgacagcgggcggccggcgctggcgaggagtaacttggggctccagcccttcagagcgctccgcgggctgtgcctccttcggaaatgaaaacccccatccaaacggggggacggagcgcggaaacccggcccaagtgccgtgtgtgcgcgcgcgtctg

SEQ ID NO: 65 - DNA, 476 bp, Homo sapiens
gaaagccatccttaccattcccctcaccctccgccctctgatcgcccacccgccgaaagggtttctaaaaatagcccagggcttcaaggccgcgcttctgtgaagtgtggagcgagcgggcacgtagcggtctctgccaggtggctggagccctggaagcgagaaggcgcttcctccctgcatttccacctcaccccacccccggctcatttttctaagaaaaagtttttgcggttccctttgcctcctacccccgctgccgcgcggggtctgggtgcagacccctgccaggttccgcagtgtgcagcggcggctgctgcgctctcccagcctcggcgagggttaaaggcgtccggagcaggcagagcgccgcgcgccagtctatttttacttgcttcccccgccgctccgcgctcccccttctcagcagttgcacatgccagctctgctgaaggcatcaatgaaaacagcagtag

SEQ ID NO: 66 - DNA, 300 bp, Homo sapiens
atcgaaaatgtcgacatcttgctaatggtctgcaaacttccgccaattatgactgacctcccagactcggccccaggaggctcgtattaggcagggaggccgccgtaattctgggatcaaaagcgggaaggtgcgaactcctctttgtctctgcgtgcccggcgcgcccccctcccggtgggtgataaacccactctggcgccggccatgcgctgggtgattaatttgcgaacaaacaaaagcggcctggtggccactgcattcgggttaaacattggccagcgtgttccgaaggcttgt

SEQ ID NO: 67 - DNA, 1246 bp, Homo sapiens
atcaacatcgtggctttggtcttttccatcatggtgagtgaatcacggccagaggcagcctgggaggagagacccgggcggctttgagcccctgcaggggagtccgcgcgctctctgcggctcccttcctcacggcccggcccgcgctaggtgttctttgtcctcgcacctcctcctcacctttctcgggctctcagagctctccccgcaatcatcagcacctcctctgcactcctcgtggtactcagagccctgatcaagcttcccccaggctagctttcctcttctttccagctcccagggtgcgtttcctctccaacccggggaagttcttccgtggactttgctgactcctctgaccttcctaggcacttgcccggggcttctcaaccctcttttctagagccccagtgcgcgccaccctagcgagcgcagtaagctcataccccgagcatgcaggctctacgttcctttccctgccgctccgggggctcctgctctccagcgcccaggactgtctctatctcagcctgtgctcccttctctctttgctgcgcccaagggcaccgcttccgccactctccggggggtccccaggcgattcctgatgccccctccttgatcccgtttccgcgctttggcacggcacgctctgtccaggcaacagtttcctctcgcttcttcctacacccaacttcctctccttgcctccctccggcgccccctttttaacgcgcccgaggctggctcacacccactacctctttaggcctttcttaggctccccgtgtgcccccctcaccagcaaagtgggtgcgcctctcttactctttctacccagcgcgtcgtagttcctccccgtttgctgcgcactggccctaacctctcttctcttggtgtcccccagagctcccaggcgcccctccaccgctctgtcctgcgcccggggctctcccgggaatgaactaggggattccacgcaacgtgcggctccgcccgccctctgcgctcagacctcccgagctgcccgcctctctaggagtggccgctggggcctctagtccgcccttccggagctcagctccctagccctcttcaaccctggtaggaacacccgagcgaaccccaccaggagggcgacgagcgcctgctaggccctcgccttattgactgcagcagctggcccgggggtggcggcggggtgaggttcgtaccggcactgtcccgggacaacccttgcagttgc

SEQ ID NO: 68 - DNA, 984 bp, Homo sapiens
acaaataaaacaccctctagcttcccctagactttgtttaactggccgggtctccagaaggaacgctggggatgggatgggtggagagagggagcggctcaaggactttagtgaggagcaggcgagaaggagcacgttcaggcgtcaagaccgatttctccccctgcttcgggagacttttgaacgctcggagaggcccggcatctcaccactttacttggccgtaggggcctccggcacggcaggaatgagggagggggtccgattggacagtgacggtttggggccgttcggctatgttcagggaccatatggtttggggacagccccagtagttagtaggggacgggtgcgttcgcccagtccccggatgcgtagggaggcccagtggcaggcagctgtcccaagcagcgggtgcgcgtccctgcgcgctgtgtgttcattttgcagagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgc

SEQ ID NO: 69 - DNA, 545 bp, Homo sapiens
aggaggcgcaacgcgctgccagggcggctttatcctgccgccacagggcggggaccagcccggcagccgggtgtccagcgccgctcacgtgcctcgcctggagcttagctctcagactccgaagagggcgactgagacttgggcctgggagttggcttcggggtacccaaggcgacgacagctgagttgtaccacgaagctcaggccgaggcctcctcccttgtctggccttcgaatccatactggcagcctctcctctcaggcactccgcgggccgggccactaggccccctgctcctggagctgcgctatgatccgggtcttgagatgcgcgcgattctctctgaaccggtggagaggaggctctgccccgcgcggagcgaggacagcggcgcccgagcttcccgcgcctctccagggcccaatggcaagaacagcctccgaagtgcgcggatgacaggaaaagatcttcagttcttctgccgctagagaagtgcgggatacaagcctctattggatccacaacctggagtcctgccttcgga

SEQ ID NO: 70 - DNA, 1533 bp, Homo sapiens
atctgcgtgcccttttctgggcgagccctgggagatccagggagaactgggcgctccagatggtgtatgtctgtaccttcacagcaaggcttcccttggatttgaggcttcctattttgtctgggatcggggtttctccttgtcccagtggcagccccgcgttgcgggttccgggcgctgcgcggagcccaaggctgcatggcagtgtgcagcgcccgccagtcgggctggtgggttgtgcactccgtcggcagctgcagaaaggtgggagtgcaggtcttgcctttcctcaccgggcggttggcttccagcaccgaggctgacctatcgtggcaagtttgcggcccccgcagatccccagtggagaaagagggctcttccgatgcgatcgagtgtgcgcctccccgcaaagcaatgcagaccctaaatcactcaaggcctggagctccagtctcaaaggtggcagaaaaggccagacctaactcgagcacctactgccttctgcttgccccgcagagccttcagggactgactgggacgcccctggtggcgggcagtcccatccgccatgagaacgccgtgcagggcagcgcagtggaggtgcagacgtaccagccgccgtggaaggcgctcagcgagtttgccctccagagcgacctggaccaacccgccttccaacagctggtgaggccctgccctacccgccccgacctcgggactctgcgggttggggatttagccacttagcctggcagagaggggagggggtggccttgggctgaggggctgggtacagccctaggcggtgggggagggggaacagtggcgggctctgaaacctcacctcggcccattacgcgccctaaaccaggtctccctggattaaagtgctcacaagagaggtcgcaggattaaccaacccgctcccccgccctaatccccccctcgtgcgcctggggacctggcctccttctccgcagggcttgctctcagctggcggccggtccccaagggacactttccgactcggagcacgcggccctggagcaccagctcgcgtgcctcttcacctgcctcttcccggtgtttccgccgccccaggtctccttctccgagtccggctccctaggcaactcctccggcagcgacgtgacctccctgtcctcgcagctcccggacacccccaacagtatggtgccgagtcccgtggagacgtgagggggacccctccctgccagcccgcggacctcgcatgctccctgcatgagactcacccatgctcaggccattccagttccgaaagctctctcgccttcgtaattattctattgttatttatgagagagtaccgagagacacggtctggacagcccaaggcgccaggatgcaacctgctttcaccagactgcagacccctgctccgaggactcttagtttttcaaaaccagaatctgggacttaccagggttagctctgccctctcctctcctctctacgtggccgccgctctgtctctccacgccccacctgtgt

SEQ ID NO: 71 - DNA, 702 bp, Homo sapiens
aggtctcttcagactgcccattctccgggcctcgctgaatgcgggggctctatccacagcgcgcggggccgagctcaggcaggctggggcgaagatctgattctttccttcccgccgccaaaccgaattaatcagtttcttcaacctgagttactaagaaagaaaggtccttccaaataaaactgaaaatcactgcgaatgacaatactatactacaagttcgttttggggccggtgggtgggatggaggagaaagggcacggataatcccggagggccgcggagtgaggaggactatggtcgcggtggaatctctgttccgctggcacatccgcgcaggtgcggctctgagtgctggctcggggttacagacctcggcatccggctgcaggggcagacagagacctcctctgctagggcgtgcggtaggcatcgtatggagcccagagactgccgagagcactgcgcactcaccaagtgttaggggtgcccgtgatagaccgccagggaaggggctggttcggagggaattcccgctaccgggaaggtcggaactcggggtgatcaaacaaggaatgcatctcacctccgtgggtgcttgtgctgcgcaaggaattattaccggagcggttgcgatggcctttgcccggcgacccaagaagagtaagcaaactaccgtccacccagcggatcaggtccaat

SEQ ID NO: 72 - DNA, 3180 bp, Homo sapiens
gatgtcctgtttctagcagcctccagagccaagctaggcgagaggcgtaggaggcagagagagcgggcgcgggaggccagggtccgcctgggggcctgaggggacttcgtggggtcccgggagtggcctagaaacagggagctgggagggccgggaagagcttgaggctgagcgggggacgaacgggcagcgcaaaggggagatgaacggaatggccgaggagccacgcattcgccttgtgtccgcggacccttgttcccgacaggcgaccaagccaaggccctccggactgacgcggcctgagcagcagcgagtgtgaagtttggcacctccggcggcgagacggcgcgttctggcgcgcggctcctgcgtccggctggtggagctgctgcgccctatgcggcctgccgagggcgccgccgagggcccgcgagctccgtggggtcggggtggggggacccgggagcggacagcgcggcccgaggggcaggggcaggggcgcgcctggcctggggtgtgtctgggccccggctccgggctcttgaaggaccgcgagcaggaggcttgcgcaatcccttggctgagcgtccacggagaaagaaaaagagcaaaagcagagcgagagtggagcgagggatgggggcgggcaaagagccatccgggtctccaccaccgccctgacacgcgacccggctgtctgttggggaccgcacgggggctcgggcgagcaggggagggaggagcctgcgcggggctcgtgttcgcccaggaatcccggagaagctcgaagacggtctggtgttgaacgcacacgtggactccatttcattaccaccttgcagctcttgcgccacggaggctgctgctgcccggcggctgctacccaccgagacccacgtggcccctccccaggggtgtaggggtgacggttgtcttctggtgacagcagaggtgttgggtttgcgactgatctctaacgagcttgaggcgcaaacctaggattccctgagtgttggggtgcggcgggggggcaagcaaggtgggacgacgcctgcctggtttccctgactagttgcggggggtgggggccggctctcaggggccaccagaagctgggtgggtgtacaggaaaatatttttctcctgccgtgtttggctttttcctggcatttttgcccagggcgaagaactgtcgcgcggggcagctccaccgcggagggagaggggtcgcgaggctggcgcgggaagcgctgtaggtggcagtcatccgtccacgccgcacaggccgtctgcgccgtcggaccatcgggaggtctgcagcaactttgtcccggccagtccccttgtccgggaaggggctgagcttcccgacactctaccctccccctcttgaaaatcccctggaaaatctgtttgcaatgggtgtttccgcggcgtccaggtctgggctgccgggggaggccgagcggctgctgcagcctccctgctgccaggggcgtcggactccgcttcgctcactacgcccaggcccctcaggggcccacgctcaggacttcggggccacacagcaggacccggtgccccgacgacgagtttgcgcaggacccgggctgggccagccgcggagctggggaggaaggggcgggggtcggtgcagcggatcttttctgttgctgcctgtgcggcggcaggaagcgtcttgaggctccccaagactacctgaggggccgcccaagcacttcagaagcccaaggagcccccggccacccccgctcctggcctttttgccaacgactttgaaagtgaaatgcacaagcaccagcaattgacttcccttccgtggttatttattttgtctttgtggatggtgggcagatggggagagaggcccctacctaacctcggtggctggtccctagaccacccctgccagccggtgtggggaggagctcaggtccgcgggagagcgaatgggcgccaggaggtgggacagaatcctgggaaggtacagcggacgccctggaagctcccctgatgccccagagggcccttcctgggaaacctcccgggggggtgccccataccatcccacccggctgtcttggcccctcccagggagccgcaggagaaactagccctacacctgggattcccagagccttctgctggggctcctgcccccgacttcggataaccagctccgcacaggtccccgagaagggccgctggcctgcttatttgatactgccccctcccagacaggggctggtcgagcccctggttctgctgccagactgaagccttccagacgccacctcggtttgggcccccagggccctcaggggccccaggagaggagagctgctatctagctcagccacaggctcgctcctggtgggggccaggctgaaggagtggaccctggagaggtcgggaaccttttaacagccgtgggctggagggtggctactaagtgttcggtctgggaagaggcatgacccgcaccatcccggggaaataaacgacttcttaagggaatcttctcgctgagcgggtgctctgggccaggagattgccaccgccagcccacggaacccagatttgggctctgccttgagcgggccgcctgtggcttcccgggtcgctcccccgactcagaaagctctcaagttggtatcgttttcccggccctcggaggtggattgcagatcaccgagaggggatttaccagtaaccactacagaatctacccgggctttaacaagcgctcatttctctcccttgtccttagaaaaacttcgcgctggcgttgatcatatcgtacttgtagcggcagcttaggggcagcggaactggtggggttgtgcgtgcagggggaggctgtgagggagccctgcactccgcccctccacccttctggaggagtggctttgtttctaagggtgcccccccaacccccgggtccccacttcaatgtttctgctctttgtcccaccgcccgtgaaagctcggctttcatttggtcggcgaagcctccgacgcccccgagtcccaccctagcgggccgcgcggcactgcagccgggggttcctgcggactggcccgacagggtgcgcggacggggacgcgggccccgagcaccgcgacgccagggtcctttggcagggcccaagcacccct

SEQ ID NO: 73 - DNA, 1038 bp, Homo sapiens
tggcggccggcgggcacagccggctcattgttctgcactacaaccactcgggccggctggccgggcgcggggggccggaggatggcggcctgggggccctgcgggggctgtcggtggccgccagctgcctggtggtgctggagaacttgctggtgctggcggccatcaccagccacatgcggtcgcgacgctgggtctactattgcctggtgaacatcacgctgagtgacctgctcacgggcgcggcctacctggccaacgtgctgctgtcgggggcccgcaccttccgtctggcgcccgcccagtggttcctacgggagggcctgctcttcaccgccctggccgcctccaccttcagcctgctcttcactgcaggggagcgctttgccaccatggtgcggccggtggccgagagcggggccaccaagaccagccgcgtctacggcttcatcggcctctgctggctgctggccgcgctgctggggatgctgcctttgctgggctggaactgcctgtgcgcctttgaccgctgctccagccttctgcccctctactccaagcgctacatcctcttctgcctggtgatcttcgccggcgtcctggccaccatcatgggcctctatggggccatcttccgcctggtgcaggccagcgggcagaaggccccacgcccagcggcccgccgcaaggcccgccgcctgctgaagacggtgctgatgatcctgctggccttcctggtgtgctggggcccactcttcgggctgctgctggccgacgtctttggctccaacctctgggcccaggagtacctgcggggcatggactggatcctggccctggccgtcctcaactcggcggtcaaccccatcatctactccttccgcagcagggaggtgtgcagagccgtgctcagcttcctctgctgcgggtgtctccggctgggcatgcgagggcccggggactgcctggcccgggccgtcgaggctcactccggagcttccaccaccgacagctctctgaggccaagggacagctttc

SEQ ID NO: 74 - DNA, 1200 bp, Homo sapiens
gtcctaacatcccaggtggcggcgcgctggctccctggagcggggcgggacgcggccgcgcggactcacgtgcacaaccgcgcgggacggggccacgcggactcacgtgcacaaccgcgggaccccagcgccagcgggaccccagcgccagcgggaccccagcgccagcgggaccccagcgccagcgggaccccagcgccagcgggaccccagcgccagcgggaccccagcgccagcgggtctgtggcccagtggagcgagtggagcgctggcgacctgagcggagactgcgccctggacgccccagcctagacgtcaagttacagcccgcgcagcagcagcaaaggggaaggggcaggagccgggcacagttggatccggaggtcgtgacccaggggaaagcgtgggcggtcgacccagggcagctgcggcggcgaggcaggtgggctccttgctccctggagccgcccctccccacacctgccctcggcgcccccagcagttttcaccttggccctccgcggtcactgcgggattcggcgttgccgccagcccagtggggagtgaattagcgccctccttcgtcctcggcccttccgacggcacgaggaactcctgtcctgccccacagaccttcggcctccgccgagtgcggtactggagcctgccccgccagggccctggaatcagagaaagtcgctctttggccacctgaagcgtcggatccctacagtgcctcccagcctgggcgggagcggcggctgcgtcgctgaaggttggggtccttggtgcgaaagggaggcagctgcagcctcagccccaccccagaagcggccttcgcatcgctgcggtgggcgttctcgggcttcgacttcgccagcgccgcggggcagaggcacctggagctcgcagggcccagacctgggttggaaaagcttcgctgactgcaggcaagcgtccgggaggggcggccaggcgaagccccggcgctttaccacacacttccgggtcccatgccagttgcatccgcggtattgggcaggaaatggcagggctgaggccgaccctaggagtataagggagccctccatttcctgcccacatttgtcacctccagttttgcaacctatcccagacacacagaaagcaagcaggactggtggggagacggagcttaacaggaatattttccagcagtga

SEQ ID NO: 75 - DNA, 900 bp, Homo sapiens
caccttccccgaggtaattattttctggggggtaggggtgggggttgggagggtgaagaaaggaagaaaaagaaggccgatcacactgggcaccggcggaggaagcgtggagtccattgatctaggtacttgtggggaggggagaacccgagcagcagctgcaaacggaagggctgtgagcgagcgggcgggcgggtggctggcagcgaggccaccagcagggggggcccgggccgaggccgcgccacctcggcaccacgcgggcagccggtgcggcggggtcgccacggccaggggagcgctgggtgcccaccatggcagttatgcaagcggtgaccccctggtcttgcctccccgccgccctgcactccttcctccccgctgccgacacttggatctctctagctctttctctcccctgtgttttcaaacaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggtgcgcggggtcgggtctgggtccagggagcgggtcgggaagtctgcggcacggagcactgctagtgtcggatctgcatctccagctctgtgctgcagcttcacttgcccgccccccaccactggcttctcacccggggtctctgccaaactctggctgctgccgccctgggttcgggccggcggaaggccctgggcgtgcgctgcggagccgcctgcgaggactccactagggcgctttccaggctggactgccccgggctgcgctggagctgccagtgctcggggagtcttcctggagtccccagctgccctctccacc

SEQ ID NO: 76 - DNA, 200 bp, Homo sapiens
ctcttcccaagttacgccaccggtcgaggacggcaggagacccccgagtgcagagaaagctcaaaccggcagcgaagtcggtcctagccaagctgaaaaaacgtctcggatttcgcggacagcggcctagacacagcccgatcttccagtcctagtgccctggtcgagacggttctatccttttgcaaagaagccggaaa

SEQ ID NO: 77 - DNA, 400 bp, Homo sapiens
tctcggttgcaatccccaccctcctcacccagcagggcaggaggcacccaacttggaggagaaaggggtgggggaggtgaaacagagaccggagagtcacgagggctgggccgccgagagcaggagaatataccgtgtcacacacctccattctctcacacacgttgcagacacaaatcactgacggtttccacgtgctgcgctcgtgagcggaggtgttcaaagagggggcagatgagttacttcccgagacggaaccgggggtcccacgtccgccgccttcagtagcacaaccaatctctgaacactcaaaccgcgcatctctggcgcatcaccatcctatttaaggccacgggctccgcccttttcctcccctcccttcttttccactctttttcca

SEQ ID NO: 78 - DNA, 700 bp, Homo sapiens
ctgccagagatgtgtctgtcttgcgccccgcatgcactgcctgcggggctgcgctgcactccccggcggcgccacgggtctggcccccgcgcttctacgtgttggggggatgcatggaccttggagatccgtagttggccctaaccttctcggaatctcctctgcacgcgctgcctgttcctcctctgcacgctctgtccgttcctttgcaacttctgtgggaattgtcctggcgtgggaaacgcccccgcgctctttggcacttagggtgtgagtgttgcgccccttgccgcagcgctcagggcagcatcccgctcgaggatgcagggttctcaccaagcagtgagggggactcacgcgccgccggggagcggagccaggctccgagaagggagcaggctcgagccgctgggttttcgcaagccttggggcctctggccgcccttccatgcctccgggcgcgggcggctcagcaggtccccggcttcgggaagttttgtgcgcggatcgctggtggggagggcgcgcgggccagtggctgagcttgcagcgaagtttccgtgaaggaaactgcatgtgcctttggaggcgactcgggactgctgtagggtggactgggtgtctatggagttgcgggtcagagcgagtagggtgggtcctttcctgggacaggactgggaattggggctcgaagtagggg

SEQ ID NO: 79 - DNA, 200 bp, Homo sapiens
aggggtgtcctccaacatctctgaaccgccttcccttcctcctcactggcgccctcttgcctcagtcgtcggagatggagaggcggctgaagattggcaggcggcggccagggtcgaggctgggagactcagagccgctgaggctgccggagctcagggagccgcttaggtagctgtcgcggtccgacagcgagtccggg

SEQ ID NO: 80 - DNA, 5000 bp, Homo sapiens
tctgactctcgggctggagcagccgagacagcgctccccagcgggactacagaatcccgggtgtcggcctgggggccctggattggcagtggtggagtcttctgagcctaacagctactaggaatgacagagttgcagatggctttgtcgcccgcggggcggctcaagcgtcctgggtcccaggcctctgtcctacggccaggccgccggctcaacgggccgaagggaatcgggctgaccagtcctaaggtcccacgctcccctgacctcagggcccagagcctcgcattaccccgagcagtgcgttggttactctccctggaaagccgcccccgccggggcaagtgggagttgctgcactgcggtctttggaggcctaggtcgcccagagtaggcggagccctgtatccctcctggagccggcctgcggtgaggtcggtacccagtacttagggagggaggacgcgcttggtgctcagggtaggctgggccgctgctagctcttgatttagtctcatgtccgcctttgtgccggcctctccgatttgtgggtccttccaagaaagagtcctctagggcagctagggtcgtctcttgggtctggcgaggcggcaggccttcttcggacctatccccagaggtgtaacggagactttctccactgcagggcggcctggggcgggcatctgccaggcgagggagctgccctgccgccgagattgtggggaaacggcgtggaagacaccccatcggagggcacccaatctgcctctgcactcgattccatcctgcaacccaggagaaaccatttccgagttccagccgcagaggcacccgcggagttgccaaaagagactcccgcgaggtcgctcggaaccttgaccctgacacctggacgcgaggtctttcaggaccagtctcggctcggtagcctggtccccgaccaccgcgaccaggagttccttcttcccttcctgctcaccagccggccgccggcagcggctccaggaaggagcaccaacccgcgctgggggcggaggttcaggcggcaggaatggagaggctgatcctcctctagccccggcgcattcacttaggtgcgggagccctgaggttcagcctgactttcccgactccgccgggcgcttggtgggctcctgggcttctgggctcacccttacacctgtgtactaaagggctgctaccctcccgaggtgtacgtccgccgcctcggcgctcatcggggtgttttttcaccctctcgcggtgcacgctttttctctcacgtcagctcacatctttcagtacacagccactgggtctccctgcccctccagcctttcctaggcagctttgagggcccagacgactgaagtcttactgctaggatgggaacacgatgaaaaaggaaggggcccagtcaaaagtcctctcctcttcggtttttcttcaactgtccttcacaaaaacatttatttctgtcccagcgccctggcggatttcggcagatgggccctagggggttgtggaggccaaattcccaggatgctggtcctgcctttttcattggccaaaactgtatttcctacaacgactaaagataaccaagaactgagtagaccctgttctctcaccagatctccctggctctgtttaacttttcctggtgcaatgcgatggcaccaccagctccccaggcaggcaccactccctcaagataccatttggggtagggatttgagtcctggagagggtcagcggggcgccggggtgggggtgggaaggagactgacagggacacaccgcgagctccgcatactctcctctgccccctgtagcccggggctttaatgaccccaagcagatttcctgtctctggtctagccagctgcccctagggctggattttatttcttcatggggtttcaccctaaagggccccctggtcatgggacctggttgggaacaaatgaaagatgtcttgtagcaaatgctttcaggggagcagaaaagaagattgggcacttccagtcacttggtcactttaggtggctggaacaaaactggtgactttcacgactgctacagggtgagggggtgaagggtggcagagaggtgacaagccactgggaatcctattcagtggggatgccgacagggagtggctgtaatcaactgagcaacatctgtgtgaatgttattcacaggtcaggacagcagcttggtcttcccaggtgaggaactgaggactggcctgcatagatttgtgcagtaggtgagtagcttccaaatttattttcagaacttccatgtagtacctgcctctccatttaaatattttttaaaattttatttatttaaatattttcttggttagctttccaagagggaggaaaagaggggagttgcaacaagtagtgcccctatgctgggattcattttccagagtaaagcctgggactggcaccctgacccctaccggcaggtgaaaactccaggcaaactgctgagatcccacctgggctggctgagatagtgcctggggtgcatccctcagcagctgccacctgggccctggggccatctctttctctggcatcaagcagccaggtgtcaaggccttcccagcaatccatgctgcatggctgggtcttgttctagcaggtcgatgggcagggactggtagcttagccagggcaccagtgcgtggctgtgggtttgtgtgcttctgtggagaagcatgatgtgtatgtgtgtgtgtgggcacaggcatgaggaagggttcatttgtgcaggtatctcccatgtatatcagtgtgggagagtgcctgaggatgtgtttgtgtgtctgaaaatgggcggagggtctgttgtgctaatgtgtgcaggggtgaacatgtgtgtgacagtctgtgtgtttccctgagtggtggctgcgtgagagggtgaggggatttggtgttgtctaccatgcccggcacatagcaggctcttaataatcttgaatttaattaatgttaaatgtgtatgttcccatccttgtggaagttggtatagagcctgttttcctgtgattgtgagactggaaaatgggggacgggcaggggcgagacaggatacagaggctactgttttcttcctccctagaagtaagtacatagaagagtgggctctggcacctcacgggacatcaccaagtcctgtgtggctggctaggctgtcccaaggtggcttcaggcatcacttgaatcttttgagaccttcaggcagtagcctgccattcaccctgtcagtcagcagaagttgggcccacacaggccatagaaacacagagcagttcccgggaggacctgagctgtccctgagagcagagcttccaggagaggccgcaggaactgccttgaccggaattcctcttggggtgcaaaggtggagggacacatggtgcgaccccaggcagaggactgcagccactccgtgcagtcccagcctctggggtagccccttgacctccaggcctgcacagatccaaggccgaggtccaggctccagcgccaaattagctggcctagcagcctgcagccgctctaatctcaactaggaaggaatccttgcgcttagaaagtccaagcgaaagggtattctgattttatcccggttttaccagaaaatgctgaaaggaaaagccccgagaggacacagtgctctaggaactcggggcgccacgagcgcctcatcccctcccttccgcccggccgcggtgccctggtcgctgagggacgcggtcagtacctaccgccactgcgacccgagaagggaaagcctcaacttcttcctctcggagtcctgcccactacggatctgcctggactggttcagatgcgtcgtttaaaggggggggctggcactccagagaggagggggcgctgcaggttaattgatagccacggaagcacctaggcgccccatgcgcggagccggagccgccagctcagtctgacccctgtcttttctctcctcttccctctcccacccctcactccgggaaagcgagggccgaggtaggggcagatagatcaccagacaggcggagaaggacaggagtacagatggagggaccaggacacagaatgcaaaagactggcaggtgagaagaagggagaaacagagggagagagaaagggagaaacagagcagaggcggccgccggcccggccgccctgagtccgatttccctccttccctgacccttcagtttcactgcaaatccacagaagcaggtttgcgagctcgaatacctttgctccactgccacacgcagcaccgggactgggcgtctggagcttaagtctgggggtctgagcctgggaccggcaaatccgcgcagcgcatcgcgcccagtctcggagactgcaaccaccgccaaggagtacgcgcggcaggaaacttctgcggcccaatttcttccccagctttggcatctccgaaggcacgtacccgccctcggcacaagctctctcgtcttccacttcgacctcgaggtggagaaagaggctggcaagggctgtgcgcgtcgctggtgtggggagggcagcaggctgcccctccccgcttctgcagcgagttttcccagccaggaaaagggagggagctgtttcaggaatttcagtgccttcacctagcgactgacacaagtcgtgtgtataggaaggcgtctggctgtttcgggactcaccagagagcatcgccaaccagaacggcccacccggggtgtcgagtcttggtagggaaatcagacacagctgcactcccggcccgcgggccttgtggcatataaccatttatatatttatgatttctaattttattataaaataaaagcagaaatatttcccgaagaacattcacatgagggcattacggggagacggcaagtcggcggctcggggggcgcgctcagccgggagcgctgtagtcacagtcccgggaggaagagcgcg

SEQ ID NO: 81 - DNA, 1500 bp, Homo sapiens
tggaacaagtgtcagagagtaagcaaacgactttctgagctgtgactctgctcctcgactgcccacgtgctctccgctgtctgcactcctgcctcacctgggctgactcggactctccacctcctttgctgcttccggcatgagctacccaggagcctaaggcgctccttcccgcaactccggtccccgcgccccgggactgcaaatcctttaaacagaggccccagagctaggggttttcccaggctctggtgggcgtgggctgacagtcgctgggagccccgcaacaggggggatgtccaggcaggtatgcacccagctcccggcgtttcccggagtcaccacaatgtttccctttctctctcccccacgtatgctgctaggggtactccccagataggattttctttgtcttttctcctagtaacaccgaagccctctcgtgcccggggactgcagaggaacgccagaccatccggaccttgcgggatggctcggtgtgtgtgttttactgtgtgtcggagtgtcgcgcatgtgtgcgtgttggggcgcgttatcaacaggggcctagggcacccccactctttcttgctctcttcccccatcacttcatggacctccgaggcgcaaagcgctcgaccctctcctgggctcagtggcttgggtactccgggctgagctcagctggggagtccccttacccagcccgcaccggcaccccgaagcttcaaagttgcggcaaacagttgcggggagcagaggaactgaggtccaggccagcgcgcccgcggtcgctcgccttggggagcaggctgagccgagggtcgtgcgggtgcgcggcagaggcggtaggaggcggaggagaggggggagaaagagggggcggtggggaacagctgccggggtaggcgaggcgcaaggtggctccccgcggccccgcgccccgcggctctcggacgcaccaggcagccaatggctgcgcagaggtgtacagcagatggcgtctgactgcgccgttccttcctcctcctcctcctcctccttctcttcctcctcctccttctcttcctcctcctcctccttcagtgctgaggagccagagtcgccgccgggttgccagacgctggaatgggtggtcttccgacacacaccaccatctttcttgcgctcgggaagctcggggctcagcggctcccagaggttacggcggcggctctggcgagacgggtgagtgcaagcacgcggagccccgagtcggggatgccgggccccctggccggccgactggggcgcggggtggcagcgccggggaagggggcgcgctgccggcgcagactttgctctttcctcgccggacagccatcgtcgccccttctcccagccagacgcgggaacttggaagcggatcttctcggacgcctctggcttggggctgcgggaagcgtgggctgcccggggcgcagtgtgcggagaccctctaggcgggcggggacgccccac

SEQ ID NO: 82 - DNA, 800 bp, Homo sapiens
gttattatccacggggtcctaattaaagcttgattaaaatgcccttctttctctaaaaaattacgaactaggcaacttcatacattttgaatggcgcagtgtttcctcttccaactgtttagtttgtagtatactatgtaagcaacatcaattatcaacccttgcaagatgacaacatgagcctgtgggggaagcacttgaggggagggaggagaaacttctcttttttaataatcagccggaaacaatgtttaacaagaatctgatgaggtcactgcagtaaatatttttcctcttacagagccaatcatcacggagggatcccctgaatttaaagtcctggaggatgcatggactgtggtctccctagacaatcaaaggtgtttgctttctgctctgttgcttttaaattgtatgggaaaggaagattggtccgacggcgcgcttgtggcccggccggagcttgcgtgcgcgttctgacggctgggtgctgtgttacaggtcggcgcagttcgagcacacggttctgatcacgtcgaggggcgcgcagatcctgaccaaactaccccatgaggcctgaggagccgcccgaaggtcgcggtgacctggtgcctttttaaataaattgctgaaatttggctggagaacttttagaagaaacagggaaatgaccggtggtgcggtaacctgcgtggctcctgatagcgtttggaagaacgcgggggagactgaagagcaactgggaactcggatctgaagccctgctggggtcgcgcggctttggaaaaacaaatcctggc

SEQ ID NO: 83 - DNA, 40 bp, Homo sapiens
tccctgctgtgggacccgaggagaggagaactggttcgct

SEQ ID NO: 84 - DNA, 500 bp, Homo sapiens
tctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtgagtacaacctgctccctccccgggcacagatatgacagaggggcttagagggggcccagctttgagatgggttgttcttatgtcacaggacagagtgatctgacatgcacacttccccgccaccctgtcat

SEQ ID NO: 85 - DNA, 500 bp, Homo sapiens
tgtcctcgaagaagggcctgagcagcagcagaggaccccaggcgaccgtgcctgagccgggcgccgacgacgactgagcacctgatatgtccccggcactcgcagccccgcggccggagtcgctgtgggtgagcggtcgtcgagcttcacagaggccgggctctgtgccagggccccgacagggcaggaagcagatagagtcccacaagcacaagcccagtgcgcagaaagggttacttaaaaaataagttctgtgataaaatcaaacagggtgaagggctggaaacaggtcatgagggcgcaaacaggtcgtgagggcgcaaacaggtcgtgagggcgcaaacaggtcgtgagggcgcaaacaggtcgtgagggcgcaaacaggtcgtgagggcgcaaacagatcgtgagggcgcaaacaggtcgtgagggcgcaaacaggtcgtgagggtgcaaacaggtcgtgagggcgcaaacaggtcgtgagggtgcaaacaggt

SEQ ID NO: 86 - DNA, 300 bp, Homo sapiens
aaatgagacctctggggagactgtcaaccccaggggtaaaacaaaaattctgatcagaaactgagtttcccaaagaaggggctaaatgttttccaacactttcggggctcagggaagatgactctgtaaggacactgagaatcttcctcgcgtgccacggggaggaggactgggggcgtttgaggggctcagcgcaccagaggagtgaggtggaggagggcgttcccgcgtcctcctcttcaatccagagcagctcaacgacgtggctccctttctatgtatccctcaaagccttcgcgt

SEQ ID NO: 87 - DNA, 600 bp, Homo sapiens
taggctctagtggacctagcagtgggagagctacttgggctggtttctttcctgacgctgcagggatgggcatcggcctggaaccagaagcgcaggagctgggccacggcagagtaattaagaaaataatgaaattgatggcggatgggggcgctagaaatcctggggcgtctacttaaaaccagagattcgcggtcggccccacggaatcccggctctgtgtgcgcccaggttccggggcttgggcgttgccggttctcacactaggaaggagcctgaagtcagaaaagatggggcctcgttactcactttctagcccagcccctggccctgggtcccgcagagccgtcatcgcaggctcctgcccagcctctggggtcgggtgagcaaggtgttctcttcggaagcgggaagggctgcgggtcggggacgtcccttggctgccacccctgattctgcatccttttcgctcgaatccctgcgctaggcatcctccccgatcccccaaaagcccaagcactgggtctgggttgaggaagggaacgggtgcccaggccggacagaggctgaaaggaggcctcaaggttcctctttgctaca

SEQ ID NO: 88 - DNA, 800 bp, Homo sapiens
gaggttgctgactcaggagccaggagctgagaaactcctaggctagcagccgttgagcctaattttattttctggctttctccgaaatgtctcgtttccctcatctttctggtccttttcgtctctcttattttccccaaaacgtctacctcacttcgtcttcctttctcctcccctccccctctctttcctctatactctcttcccatttagccttgcaggcccctcctccccggtgttggagagctcaaagacgcgcgaaactcaaggatctggccctgaccagggacgggattaggcgggaagtggtgacggcctgaaaaggctgggctcgaacccgtgccttcctgaaaggactctccccgccacaagtcacacccacccgcaggcctgctggccaaagaaacaaaggagtcgggcgtggatccaggagaaacaggttttcgctctcggatctccctgggcaaatcagggatcctgagcgctataccccgcagtcgtacggagcctctgggaaaggggatttaagggtgacttccactttcagcttcggctacttgttgcctgcggtccaagccttctctgcttcctcctacctcgtcttaggcctctgtagaaagtgcacgccgcgtttccccttccaggctctgagagggcctgcaggcccgtggccgcctccgacaagatgccttccagtgctaggggggccactttggcgggatgggggtcggttggttaaaaaaaacttaagttctggctcagtcgagtgtggcaaaagccgagggtcgggggttgggggg

SEQ ID NO: 89 - DNA, 2000 bp, Homo sapiens
tactgacctggtctccgcctcaccggcctcttgcggccgctgcagaagcgcactttgctgaacaccccgaggacgtgcctctcgcacagggagcgcccgtctttgctggggctggagcggcgcttggaggccgacactcggtcgctgttggactccctcgcctgccgcttctgccggatcaaggagctggctatcgccgcagccatagctgctcagcgagggcctcaggccccagcctctactgcgccctccggcttgcgctccgccggggcgagggcaggacctgggcggccagggaaagggcagtcgcggggaggcagtgctaaaatttgaggaggctgcagtatcgaaaacccggcgctcacaaggttagtcaaagtctgggcagtggcgacaaaatgtgtgaaaatccagatgtaaacttccccaacctctggcggccggggggcggggcggggcggtcccaggccctcttgcgaagtagacgtttgcaccccaaacttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggccggccacccgagttctggaattccgagaggcgcgaagtgggagcggttacccggagtctgggtaggggcgcggggcgggggcagctgtttccagctgcggtgagagcaactcccggccagcagcactgcaaagagagcgggaggcgagggaggggggagggcgcgagggagggagggagatcctcgagggccaagcacccctcggggagaaaccagcgagaggcgatctgcggggtcccaagagtgggcgctctttctctttccgcttgctttccggcacgagacgggcacagttggtgattatttagggaatcctaaatctggaatgactcagtagtttaaataagccccctcaaaaggcagcgatgccgaaggtgtcctctccagctcggcgcccacacgcctttaactggagctccccgccatggtccacccggggccgccgcaccgagctggtctccgcacaggctcagagggagcgagggaagggagggaaggaaggggcgccctggcgggctcgggatcaggtcatcgccgcgctgctgcccgtgccccctaggctcgcgcgccccggcagtcagcagctcacaggcagcagatcagatggggattacccgccggacgcaaggccgatcactcagtcccgcgccgcccatcccggccgaggaaggaagtgacccgcgcgctgcgaatacccgcgcgtccgctcgggtggggcgggggctggctgcaggcgatgttggctcgcggcggctgaggctcctggccggagctgcccaccatggtctggcgccaggggcgcaggcggggcccctaggcctcctggggctacctcgcgaggcagccgagggcgcaacccgggcgcttggggccggaggcggaatcaggggccggggccaggaggcaggtgcaggcggctgccaactcgcccaacttgctgcgcgggtggccgctcagagccgcgggcttgcggggcgccccccgccgccgcgccgccgcctccccaggcccgggagggggcgctcagggtggagtcccattcatgggctgaggctctgggcgcgcggagccgccgccgcccctccggctggctca

SEQ ID NO: 90 - DNA, 800 bp, Homo sapiens
gggggacacagagaggaggggttgcgggcctgtgagaatgaagagcacagagcggagagggggaggaggagggaaaggaaggcgtggcagtgagagagaagaggaagaagagaggaggagtggggaggggagggagagcaagacagcagcgggtctggattcccctccgagccacatctggtcaggttctaagtaattagaagattttcccattggtttacccaagggctctctctctgattaattttcgaaagagttggccaattttaatcatagcaaacacgatgatcacggtgatcatggcctgaacagctaaaagcagaaaataaaacccccagaacggactatgatcttgacctttgcccgtggtcaccggctgggcccacacccagggttctgagctgttgggagccaaggctgggtggacaggggcttccgaggagctgtccgcagcggggcggggaggcgggccccgggggcccgggcactccgcgtcaccccccggcagggcccagagcggcaggccggcgtgcgccccagggcctgcgcaccgtgggggctcttccccgcccacgaggcctaggtgctgccgcagccaccccaggaagggccccaggccacagtcgcagcgccaggagttgtgccccaacaggacctccgtcagccggggcagagccccaaacacgtcgccaggcagggtctccagctggttgtggtcgagctggacgctctccaggctgctgagattgcggaagagggcacggggcagggcgcgcagcctgttgcggcgcagggacacc

SEQ ID NO: 91 - DNA, 550 bp, Homo sapiens
gccccggtgcaccgcgcgtccagccggcccaactcgagctagaagccccaaccactgcccagtgcctgagttgcagtcttgggtcctttagaaacctggagatgtgcgtaaaattcagatgccggtattcccgaacttccccaggcctcagcatatctcggcggcctgtggacagatgggaggctaccaatcgctccggcgtccgcagcccgacccctgccgccagaccccggacgtcttccggataataaagttcccgctctaattcattttccctaatctggacgcccctaatctacagcttttattgcgcccagttaaaagtcgagggaattcgctgtccctccgcgctcggataattacccctaaatggccacggcagccccttgtgtttcctggagattagaaccccgcagtcatcaatggcagggccgagtgagccgccaatcacctccgctcactccctgagagccgctggcctgggccgcaggaggagaggccataaagcgacaggcgcagaaaatggccaagccccgaccccgcttcaggc

SEQ ID NO: 92 - DNA, 2000 bp, Homo sapiens
agggtgcctctgttcaaattagaaaaaggcgccccctcagggcagactcagcccagctgccaggggacaagtcctggctaacgggagctggagctgggtttcacctccaggtgcctccttggcggggcgccccgtgcaggctacagcctacagctgtcagcgccggtccggagccggagcgcgggaatcactcgctgcctcagcccaagcgggttcactgggtgcctgcggcagctgcgcaggtggagagcgcccagcctgggaggcagtagtacgggtaatagtaggagggctgcagtggcagaagcgagggtggccgcagcacttcgccgggcaggtattgtctctggtcgtcgcgcaccagcacctttacggccaccttcttggcggcgggcgccgaggccagcaggtcggctgccatctgccggcgctttgtcttgtagcgacggttctggaaccagattttcacctgcgtctcggtgagcttcagcgacgcggccaggtctgcgcgctcgggcccggacaggtagcgctggtggttaaagcggcgctccagctcgaagacctgcgcgtgggagaaagcggcccgcgagcgcttcttgcgtggcttgggcgccgccggctcctcctcctcctccgcgacgcctgccggcccgctgccgcccccgccgccggccccgctgcacagcgcggacacgtgtgcacctctggggccaacaccgtcgtcctcggtccttgggctgcggtcgcctgcggaccccggtgggaacagaaacaagagactgtcagcgccacagacgaggtgaggccgggcctcaactgcaggggtcacgggagtggggcggaaatacactttgatcccactcaagcggagcggaggtctgggaggccctgggcccgggagaccagtcttagactcttgccccactgggtatcccatctaggcctcttctggggagggcggcagactcagccgctgtgtcaacgctgtgttgtcgagaccagctccccaccctctctgggccccaggctcccctcagtaacttggggcactcgacccgagcatccgcgaaagccctcccggctctcagcgttgagcattgggattctagactgcatttccgtctctctgcttgggttcacgcgcctctccacacttagttcacacgcacacacgcgcgcgtcctcgcagcacacacttgtctggtgcaggtaagggaaggtggaggcggatcctggggccaaaggtatttagaatctttcaccctcagccgcctgggattgctgtgagagacatggaaacaggctgagccgaggccttagatgagaggatggactggagagtaaagagggagggttgcccctgcatcgagtttttggaccctgatcccacaccagcttctcggtctcgtacccgcccttccgaagaactccagcagaaaggtccagcggtcccctgtgcttgaggcctacagaagcttgtacccaactagggcaggcacccgggtcttccagaccacaggacaggacaggccacggctgaggaggcctctctcctgcctccaggatgaactaaagacccaatccgggatcttcggcctagggctgctctcccagacctggggtctgagaaagccaaaccagccctttccccaaagctctagttctgcagattctcagctctggcccactcggaggtgttcttcaccacctatccacctactgtggggcccggccctgggaccttgaactggcaggtctctggtccagagctaggtcactggctacctgaggtctctgaacccctcacttttccgcttccctgattttggggatttggggacagacacggcagaaagcactggcgacgaactcaaaaactcccgaacgcaaggggcagcggttctcccaacccagtctaatgcacattggcccaggatgtctcaggcctcaccccaggacgtagggctctgaggagctactccggtctctcgcgggct

SEQ ID NO: 93 - DNA, 1000 bp, Homo sapiens
gagaagggatgtggcggggggctcctccggccctggactccctgggtggactagaaaagggcaaagaagtggtcacatctgtgggccagactggtgcgcgatctttggaggcgcagcagcaaggccgcgccagggctgagcccagaccgcccacgaggaggcccgccaggcccggagcagcggcgcgtgcgggggcgtgccgagcgcaggctctagggcccctgcttcgccccagctggaccccgcgggcggtcggtgcagctcgagcgtgtgggctgcgatgccctgcctgagacttcgggctagggatgcgggcgggaagtgggggtgcggcggcagctgcagattagattccttttttttttggccggagggacgtgcaaacttctagtgcccgggccaagagggcgaccccggaggtgcgtaggtggccctccgggttcccgcttctcctagtgcctctgaaaataccgtcagggtaaagggagacaggcagtaagtcttaccaccaccgccctttccccatgtcattggccaaaaactgaacattaagataaagcagctgtttcagtcaatggaaagcggtagggcgaggttgtacccaaaacccggtttagacggccaatgaagtcctaggaaaagccgccccgggggcacgttcaggtggagcggctgcacctcgggtcgttctaagggatgggctgcgtggtacccacggaattcatgggtccaaaaggtcctggtcacctgtccaaacatccatcccctggcgcatggcggttgacaagatggcccggccacccagaggaaggaggatccgggacggggaacttcgcgccgggaagctgtagcccagagctgcagctcagcattcgcaagagattcatcttttttttctctcgtgttcggagaaacagataaacaagacaccgcctcatcagataagaacgtctccttcgatgtcacggatttcaagaggtagctggagaaactgacgtca

SEQ ID NO: 94 - DNA, 1300 bp, Homo sapiens
caggtcaggcagaacttctgcccttcccgctactggcaccccaagcagggatgcactgggatgcgtggcaggggcgggatctcctgggagcgtctcagcccagcagggagtggggaagcaagagggaaggcttaccttcctcggtggctggcaggaggtggtcgctgctagcgagggggatgcaaaggtcgttgtcctgggggaaacggtcgcactcaagcatgtcgggccaggggaagccgaaggcggacatgaccggggcgcagcggtccttcacctgcacgcagagcgagtggcatggctggatggtctcgtctaggtcatcgaggcagacgggggcgaagagcgagcacaggaacttcttggtgtccgggtggcactgcttcatgaccagcgggatccaagcgccggcctgctccagcacctccttcatggtctcgtggcccagcaggttgggcagccgcatgttctggtattcgatgccgtggcacagctgcaggttggcagggatgggcttgcaattgctgcgcttgtaggagaagtcgggctggccaaagaggaagagcccgcgcgccgagcccaggcagcagtgcgaggcgaggaagagcagcagcagcgagccagggccctgcagcatcgtgggcgcgcgaccccgagggggcagagggagcggagccggggaagggcgaggcggccggagttcgagcttgtcccgggcccgctctcttcgctgggtgcgactcggggccccgaaaagctggcagccggcggctggggcgcggagaagcgggacaccgggaggacagcgcgggcgaggcgctgcaagcccgcgcgcagctccggggggctccgacccgggggagcagaatgagccgttgctggggcacagccagagttttcttggccttttttatgcaaatctggagggtggggggagcaagggaggagccaatgaagggtaatccgaggagggctggtcactactttctgggtctggttttgcgttgagaatgcccctcacgcgcttgctggaagggaattctggctgcgccccctcccctagatgccgccgctcgcccgccctaggatttctttaaacaacaaacagagaagcctggccgctgcgcccccacagtgagcgagcagggcgcgggctgcgggagtggggggcacgcagggcaccccgcgagcggcctcgcgaccaggtactggcgggaacgcgcctagccccgcgtgccgccggggcccgggcttgttttgccccagtccgaagtttctgctgggttgccaggcatgagtg

SEQ ID NO: 95 - DNA, 500 bp, Homo sapiens
tgcgatcattaaaatcagttccttccctcctgtcctgagggtaggggcgggcagattttattacttctcttttcctgatagcagaactgaggcggggttgtggaggagcgacggaggaccacctctaacttcccttcacttcctggatttgaagcctcagggccaccggcctcagtcctgttacggtggcggactcgcgaggttttccagcagctcattccgggacggcggtgtctagtccagtccagggtaactgggctctctgagagtccgacctccatcggtctgggagcgagtggttcgagttcagatgctgggaaccgtcgcttctccccggccgggctcgctgttttctcctccgctcgccgtcatcaagcccggctatgagcagggctttaaatcctccctccctcacccgcaggtttaccgagcagccccggagctctcagacatgctgcgctgcggcggccagaggaggggtgggggcattgccctctgca

SEQ ID NO: 96 - DNA, 500 bp, Homo sapiens
gggcttgggccgcaggcttccctggacttccgcagtcccccttctccccattccagaacctgccgagcccctgctgcatctgggacccgccttcaccgtttcccaatcccagcggttagcccctgcgccccctttttggtctccactttgccgttcgaaaatgcctaggttggtggatcgaccctccgcggagcaaagacggatggctggcaggagcaggttcaggagctgggccaaggtattctctgcttccgcctttgtgtccgcccccccgccccctgctccccgcttcccgccagcatctctccttttctgctcaggagtgtttggcccggcggtccaccccggcttcccgagatacgctagagttgcccccacgtcctgtccgccgcgcccctacccaccgggttgccttcggggcccttcggtgctgtgtagtcggcgtggcgctgtgagctaggcgaacaggaacccccaggcccgccacgtctacgctatta

SEQ ID NO: 97 - DNA, 600 bp, Homo sapiens
ttctggggcctggatgggtgcgagcgggacccgggggagtgggagtcgccaggctctgagcaagcaagggctgcacctgcacctctgccgggcatgaagaaaggtaaggaaggaaggagctcacccgggtgggagacagagccggggcgcgcgagcttggtgtgggggcgccactccggggcggaggggaggggctaccagtgacttctccgagtcgggagctagaaagaggcttccggccaggttcccttggaacaggtgtcggagttgttgggagagggggctgcaagaaagaggggtgcagaaactggttcattagatggaggctctgggcggaaccgcgaggacaccctggcagcgcgctgtgcctgcgttaggccgggaggggagaggcctccggacggcgaagtgtccctagggacccagacgcctcgggagcgatccgggccgctgcgaagccctgcccaccaggagtggatccccaggattcacctcccggctgcctgctctgagctgagaaggggatctggttcttcacaataccgtggatggcggggaaggggagggagcctggggtaaaatcccatcttggtttcctcg

SEQ ID NO: 98 - DNA, 1300 bp, Homo sapiens
tgtcacagaaaccccagcagcgcagccaccggactgggttctggaggccgagccgcagtccgtgcggcggcgctgggaagagaaggcgccccggcagctcccctgccaccggccccgaggagcggctggctcccccagcccagcgccgccgccgcccggtaactccaggcgcaactgggcgcaactggggcagctgcgacaccgaatccctcacatctgcaacctgggtgctgcggccactgagaaaatggaggcgcagaccaacgagcggtgccgcgaccgagagacctcggctggcgaaatggtggtgccgggagcctgcgagtgacgccagccggcggggttgtcaaggacaacattcgttttgacgcagccaatggcgccgtcaccaagaaaccatcgactctgagaaaaaagagaggttcggccaccgagaaactccgtacgacaagtgctgtggcagaaaaaccgcctactccgcgccacaggcaaaacagccaatggaaaccccaggtgctgcgaccgtgacaccggcactagagggtctcggatggagaaagcggcgcacggagaccaggaaactatgtgtagcacaactagcagaaaaccgtctggtcggccatccgggagaaagcgcggatcagaaacaagcgacttcgatgcagggaaccgcgcagccactgaagaaagtgacccacgtggcagtggtgccagcgaaacactgcagtttggacggcagctgtggggatgccacagagaaacatgcactgccactgaagtacatccagctccgcggagctagtgttcatatgatcaagaaaccgccagttgggctctgctagaaacttttagtcctcccttaacggctatcctacccacaacagacaatgcctttacccagcacctagcggtgctgagacccgcctgggccagcacagagcgcagagcagtacgggtacggagaaacgccggactcagtgaaaccagccttgcctccagcggattccccggcttcgccggacgccacaggcagagtgccgcggggaaacctctggctccctaaaccgattagattgtgggagtgggggggacactcacaagttgtgtggaagggaaccagcggcaatgggacccggcgagcacttgcccgcagcaaatgcctgcgctgctgcaaaaaaaacaacttttggcgcaaagaatgttgcggccagagagcatccgctgtcgctgacaaaggagtagcaatggcaatgagaaaccgccggcgccacggccgaccgcggcggctcacgcctatgat

SEQ ID NO: 99 - DNA, 2100 bp, Homo sapiens
caaacgctgagagacaaaaagacaccaacacccaccaggactgcgtcctgccagctcttcactccgctgacctgaccttccacgcccctagtcctcgagcggacttgacctgtgggggagtaccgaaccgtccccatgaggccctccaagcggccaggtggcctccgccactctctccacccccacctcctccaccccccagcccatcggtccatcttcgatctgcaaaacacgccgggtcagcgacgcatcggtcccaggcttgtgaccacctctttctctgttacttggggagccaggcccaccgctcaggatcacagtgaggagaaaaaagacacaaacgccaggacagggcggctggggaaggaaactgctagggaccgctcattgtcagcctggcgtgtcccacggatcgcaggacccgtcgaggctttgctctctgcgacccgaatactcctgggcctctcgacctcctcctcggactcaggcgtccgcgtctccggtcatcacgggagaccaattggtttacaaatagtgatgataaacctgggaccgaccttggggctgtgtaaaagtctactgacagatgtaatggagggttgttagcagtcacaaagcctgtcggacccgtagcattagttcaagagactattttcgtgtcgcaccaaaattactgcgcgtgtaaaccaatttccccgacggaagaataaacagagattcgtttgaagcgcgagatgaaaacagatggggtatcgcaaacagttccccaaaatacaacagacttctgggccaattacacgtggttagctctgaatggcagaggaaatagttttctttgctgctaaatgtcacaaaagtcacctaaaggcacagaggaggccgctctgtttttgcgaaacttgctaaaattaatctgcgctgggccacttgcagaaagcagaaccacctcccgcccccacctcgcctccagccgccggggttcaggcgtttgtgaaagacagaacctttgggctagggacccgggcactggtgcttcgaagtccgaatccgccggccgagaaaacgacaagagaaagaaaatccagcgggcgctctctccagcgccaggccggtgtaggagggcgctggggctcggcctgccacccctacccgacattgggaagcagcccctgcgctcccgcggcgcctcagcctccggtccccgccccgaggtgcgcgttcctcctcccgcatgcccgtctcgggccccacggagcaagaagatagacgatgacgaggcgcgcccatccatccgggccgacgaggtcaggcccgcgccacaggcaaaaattgcgcaagcccggccgcagggatttcgcgggcgcctgggtcccaggtgcgcggccgaaatcctcagggaaaatcccgaggggccaacggtctaggccacagggctgctgggcccgggcctggctcagagcgcattcgggcggggaggccgcacgccgcacccgggcctctcctccgagcccgaggcaggcactgagctccgggccagccaggtgcctcccggctggtgcgagaccccgggcctgctgggaggcgtgggcagggcagggcagggctgaaccccagcgactgaatctcgaaggcaggaggcctcggaggtcatcggcccagctcgcctgaaactgtccctgctcgtgccagggcgcgggcagaggagaaaggacagggcggagcaagcccactgcagaactgcggtcggtggctgcgaagggtccgggtcaccgcgctcccggacgccggaagccgcgctggcggggccgcggggagggaggctgggtaccggggccgtccggccggaggaagcggctccggccgcgctgtccgcgcttgggagccgcgtgcagggttcagccgtgtttcagttgccctctgacctgaccccgggcgcacaaaggcctcccgggtgcgccgccatggcccagtcttccagtcgctgccaaattaatgagcccacgtcaggttgggtttacagctcggccgggaagcagccgagtggaaaatgagctcggggccgctccagaggctcccgcacaactgcagaggctgcccgcg

SEQ ID NO: 100 - DNA, 250 bp, Homo sapiens
tttccaagacagaaggagggaactaggcgccttttttccactccgctgaccccaacgtctgggctgtgcgttgtaacgcagttggcggggccttcagcttgggatgagggcgaaggggctcgggatgggtgggaaagcaaggaccgggcaacaggtggggaggtggcggacttttgtctcggggaaggaaatcggctgtgctgaaagggcggaaagcagtagcgcacagaactagtgtctgcggggtccc

SEQ ID NO: 101 - DNA, 250 bp, Homo sapiens
ccctcctgtggctgcttgggcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatg

SEQ ID NO: 102 - DNA, 2000 bp, Homo sapiens
tcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagcgaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccaggtgaggggctcggcgccgccccgggcgacccctgggggcggcactggagaagccgcccgtcctcataagggattgaacttgcatccactcctctccggccggcttggtcgctggctgcgctccacccgattctcgggatcattggaccgtttgcgcgaaaccagagtggccgattaagggatggggctccgagcaccgggggtggtggcgactgtgggcgaggggaggtgggaccgacccccacccctacactcaaaaaaggccggggcctccttcgagcttccggtgaatttcgggcgatttccgcgggtgtcgggggtcccgggaggaggcagtcacagatccacccctgcagccagcctcctaggcgccggctccggcacgcttcgccggtctgtagatttcctcttcgatttctccccagctcccagcatctgtgacttcactgttaccctccctatccccgcatcacccaaccgcacctgtctgcgggacttaggtgtgcgcgcggggctcatgcgtgtcctccctgctggccacccccacggcccacacaagttgcacgggctcgccacgccccgccaacacgtgcgcggacgcacgcacgcactcctcgcacgtgggcttacgcgaataccagctttcactgccactcgctcgcggccagattcacaggcctgttccggtccactcgcagctcccctctgccgctccctccgccgggctcaggagtactcgtagctgattgtgcgcgcctgagggtcccagatcgcggccgcccaggaccaggcgaggactccggagcctcctctcacctctcccacctgcgccccgggctgggccgggtcgcctggggggcggcctgagcgaggcgcggggccaggagcgctggagcgactgccgctctaagtgccgggcgggcaggactctacgatccttgggccagaggtccggatggtcccgggactccgtctcaagggtcggcgacccctcaacccagaagcctcgagcaggcggacaggcagagctgcccagtggccgaggcgcgg

SEQ ID NO: 103 - DNA, 1100 bp, Homo sapiens
atttgtcgttgtgccattgctgccactgttgttcttgtccagggaaacaccggtggccaacccagatcggatacaatggtgcggctctggactgagcctccaaccacattagccatgggcagcattgttgctgccgctgctgttattttaattatgattgtacgttaaccaccaccttccttcctctgcctcccttcagctgcaatgatgtatgttactttttggtaactggatttcattaacatttatgaactctcataaagtagtagaaaaagcaatttgtgtggaagaattttccacctcattaaacagtgttcttttgggggtcaagctgatattttttttgttgttagattttttttataggtcctttgtccttccctaagccctgggggatgaaaggagagccgtccacccagcgaggggcttgtgtgccctagagggcgctgggccccgcgcgctttcctggctgtccccgccggctttccaccctccccaaagcccaggtgcccaccgtgggtcgctgcggcctttccccttcttggccaaatccgattacttcgcagcctgcagatggcatcgccggctaagggcagcctgcggcaggtccccgagcctgagcactcctcctatctggggcctgagaggacgctctgggctttttcccaggcccagggtgcgcggcctgctagcgcctttcgaggcacagtcccaagataggctcttgtccttcgacgcccccttggcacaagcgcactggcgccctccgctcaacccaccttgcctttggggcgggcttcaaccctgggaagacaggcctgggggaagcgagaggagaggcccgaatagaggttccggctcaatctttcccagacggaggcctggtgtttccagctcagttgcatcttccagccgcgggctcctggcccaaacagaatgtgtttgctttcacaccgggacggcaagcggagtccgcctcagtgagcagcgagctgcgcagtccggacgggtgtcgcccccagagactcgccagccgcccccagacactcgccagccgtccccatctctaatccaccgtccaggcccgggccctgggaaga

SEQ ID NO: 104 - DNA, 800 bp, Homo sapiens
ccgtgtctcccttaagaactggggcctcatctccactccagctgcgcgtgcacgtgtgctcccggcaggacgcgcgcccaggagcgcgctgggggctgccccgcccctctctccctcccccgcgggtaaactccgggcatccatcagtctgttaattgcactaattagagatcgcagaggtgttaattggaaaaccctggtattgtgcctgtttgggggaagaaaacgtcaataaaaattaattgatgagttggcagggcgggcggtgcgggttcgcggcgaggcgcagggtgtcatggcaaatgttacggctcagattaagcgattgttaattaaaaagcgacggtaattaatactcgctacgccatatgggcccgtgaaaaggcacaaaaggtttctccgcatgtggggttccccttctcttttctccttccacaaaagcaccccagcccgtgggtcccccctttggccccaaggtaggtggaactcgtcacttccggccagggaggggatggggcggtctccggcgagttccaagggcgtccctcgttgcgcactcgcccgcccaggttctttgaagagccaggagcctccggggaagtgggagcccccagcggcccgcagactgcctcagagcggaagaggcagccgcggctttgacccagcttccttccgacggcatctgcaggagcctctaggcctgacataggctccgaggtgccctggctcccccacggggaatgctgagggttgggccactaggtcctgcctaagtgcaggacctgagcctcagacaaatc

SEQ ID NO: 105 - DNA, 300 bp, Homo sapiens
gggattgccggctttgagaaaatatgaagaaaccgatttctccttccactttgccagtgcactttccttccactttcactggtgctgggggcggcgcactctttacgacatataagcggaaaattctgcaaaagtggcccccggggatccccgcccgacccctgtctgtcgctaatgtgggcctgtctccggaaattcgaggttgggcctttgcctgaatctgttgctattgctccccttgctaccgctgacacttggcaccgccgcctcctagcagcggccagacgcggggctgggggc

SEQ ID NO: 106 - DNA, 400 bp, Homo sapiens
gttgcgagcgcggcacaggttgctggtagcttctggactctggaggcttggccttccttctaagccgatggcggggaaagaacctcgtttccacagcttccccgacccccgccgcttgccatttggggacgggaagcgcgcccgggtcgcttcacgtccctctgggccggagccctttccatggctggctcctctgggggcccttgggcctgtgagcagcgtctccttccctcagagaagaatcctttccttcccccatcgaagtgtccctttctgtatcctgaaataacccctcctgggtgaggccagttcccctctgtcgccctcctcccgcaggcgtccgggagcctcgtgaggaccccgtgcagttgagtccaggcgacaggtgcctccccaggtg

SEQ ID NO: 107 - DNA, 800 bp, Homo sapiens
cagtgcgccccttaccggagcacccatggcctcccgcgttaccccaaattttgtaggcagactgtcagagttcgaagccagctgtgtcctctgcgggccgtgtgaccctaggctatctgggctgctcggagccttagtttccctagttgtgaagagggagggtgtgaccatggcccggagctctccgaaaggctgtgcggattgctcggtggcgggatgtggagcgcgtcttctatgatgccaggtgctggccaagcgctcgatgcaggctgctccagttaggtcgatgcgatggcgggaagcactttcctctgcaatggagagacgccgacaccccgagcccgaaggcttgcaaggcgcgctctcgccactggggtcggggatccgtgggttctctatcccgcttacccactccatccttagcagctgtcgtcggtcccagacctctaccttggagagaccaaggcggcccagagcccaggagactactgcgcggtacgccaggatccagaagtggattctgacttctaaagacccctcccaagccaacgctatcagggtccctgcaagcggttgactgtggcggaggcagaaccaaaacctttgctctgcccgcggcgctccagcctctcacccaggacagtgctctgggctccagccgctgcagtggggtcgggacacagacgccgagttagaagccccgccgctgcaggtccctgcttggtcggcgcggtgacggtgtcgctggcggcggcgggggccttcctttggctgcccggccatttaatcagagctattat

SEQ ID NO: 108 - DNA, 1000 bp, Homo sapiens
tttagtatttaaggagaaaagcctcattttccagaatcgaataagcgaattaatcgcacaattgtgtagaatggaactcagtctgtaaaaaatcaagaccaacgtactttttaatattctaacatctccaagtagtagttacaagtattgtacccatgaagtccaggtaattaatttgttcaatgtcacactgttaaaagtcaggtgggctccaaagcacagtcctaaccagcatgctctactgcctcctctgaggcaacagccgaagtgcagaccactgggaataaatagctgcccggtcttccccactcctaaattctcccgacagaccccaaagcctctctgagagcctctctgaccgccctgcggcccaccccgagttcccggcatcctctgggatccctcttcctggagccaaaacctacgcaggctcctttcctccgagctggttgctaggtgatctccgaaggctgtccgaagtctcgcgagggcggacccgttgcctgatgacgagagttgggagtgtggctggggctgcggatctccagcagtggcgttacttctagcggctggataccgggttctccgcgagatcgcgagatcccgagatattctccccgcacggaagcgacgactggcctggccagaggactcgcgtgggagcgaggtgccggccccgacaggacggtgaggtatgcagaagtaaggcggggcgccccctgcgggaagcgagcgcgccccggaaaatgagcgcctccccacaccaaggtgtccaggagtgagtgcgggaaggaactcggccgcccggagttgtggcctcatcgtgcttcccgccaaaaacgccttggtactgtcgggacgcggctaagcgtggacgcgcccgcatctgcccctcctccgcagtggtggaagacacccgcggagcgccggtggataagggccgtttcctgagaccagagctgtatccgcagcaggtcagcacttcgtgcgccctgtgtgc

SEQ ID NO: 109 - DNA, 300 bp, Homo sapiens
agcggcgctgttcccgggctgggtgcagctgctaaggacaaggcccctgctccgaagaacgcggtggctcggggataccctgaaagggacggccatggcgcacatgggatgccctagggttcgtgggagggcatgcaggcgcagcccccgcaggggttggcctgccagagaaggcaggggagagcactcggggctgcacaaatggtgtggccggagggaaggtgcagccttgtgtgtgtctggatgagggctgggcataggagcttggtatttgatcctgaaagctctgcgtttccaaag

SEQ ID NO: 110 - DNA, 600 bp, Homo sapiens
gagtcatacttgtagtcacatccttttcctttctccaacccactggttaatcatgaaaggctcttctgattggctgcctcctggcagtagtgcctcagcgcgacggttcgggagcaaataaataattcccgctgggaagctgtttctcagacaggagcagcgacacccctgccacgcctgccgcctggagttgagtggggtaagcacgccggcctccaggaatcgacggtgccacgtggttcttcttgcacttctcttcttctccagtttcaggggacaccgtggggtgtgcgagcccgggggagcgcagggaagggcgggttgggctgcaggtgggaatgtgcggtccttctgcgccctcaacagagcttccttcctttttgccaaggtccccgtgccgccttcagcgcgcctccttatgcacctctacctctgctgcagcgtacctcttccgcagccctagcggcctccccgaggggcgccgcggcctcggctgtccctcccctgcctggcacgaccacctgacccccagcgacccaagaagcaagttgtgtttgcagacgcaaaggggctgtcgttggtatcggtgcactggtttga

SEQ ID NO: 111 - DNA, 1700 bp, Homo sapiens
acactttctgtgtgggagggcacaagacatgggctatgacatggccagagaccccaccttctttacacatgtaaaaaccaaccaaatcaagatgcgtcaacggtgattcttcctcccacattgtttccctttttaaactgttattttttcaatccatggagcagttgagaaacgggtatgcatctctcctcccctccccttctatcaaagcctgtaagacacataaggaaatccaaagccacagtaatagagagagagagagagagagagagagagagagagagagagagagagaaaacagaacaaaagaaatcctccttggcttgtttttccagggtggccaggcaaggtgtgaaaatccatatttccctctgggctggcaggtagaagttactgggaaggctgcgctcccttctctcccaccggctctcacatccaggctgttccctcaccctcagcctcccccagcgccagcttcctcctccgcctctctgcagccaggcctcccctgcaaggcggaccttggcccaccttggttccgggccaaggcggcgggaaaggcaccgctacctgcagccgcacgactccaccaccatgtcctcgtactgcttgtagaccacattattgcccgcgtcgatgtatagaatgctgatgggagtcaatttggtgggcacgcagcagctgggcggggtggagccggggtccatggagttcatcagcgtctggatgatggcgtggttggtgggctccaggtgcgagcgcagcgggaagtcgcatacaccctcgcagtgataggcctcgtactccaggggcgcgataatccagtcgtcccagcccagctccttgaagttcacgtgcaggggcttcttgctgcagcgtagcctggacttcttgccgtgccgcttgccatggcgactggcgaaggccgtgcgccgccgccggcggccgggcgagggcagccaaggcctggcatccggggcgcccgacggcggcggccacgacccctcggcgcccgcgcccgggcccgcagcctcggccgagcccagctgctcgcgcatctctgcgaacaggttcttgcgctgggatctggtgaataccaccagcagggcccgctcctggggaggccgcaccctccggccgaagcccagactccgcaggtccgggggcggcggttgctggggtccccgcgcgcgcgcctcggcctccccggcgtccagctcgccccatgcggcccgcagctccaagcacagctgcttccagggctggtggcgcaggccctgccacacgtcgaagacttcccagccggccggcggcgccccctgcgggtccagggtccgcgcgtccagcagtaggggcgaaaggcaagggaagagctgcacgtggagcggcccggctggtggcccccagggcgctgagggcgcctggcgaaagagccgcagctccgcgcccaccagctcttctttgtctgagagcatggacacatcaaacaaatacttctgtctccggagaggagtgtgcgagagatcgtctgcgagataaaaaataattacagtcagtttcacttaagggggagatcagcccggtgctcttcggccgccccgggaggaaaagggcggggagtgggggcaggtcggccgggcagtccagcttgcccggcccagggcctgaccaccccggctccccatctggctggtgcatgg

SEQ ID NO: 112 - DNA, 2000 bp, Homo sapiens
gcccgctgtgaatgtaggtgaggtgatcccgggaacctgggtctgaaatcagacctgtgttgccattgggagcacggagagaggggaagcgccctgcttaggcccaggccgggcgtcctggtggtgggaccgcagccgcactcacctccaggccaacggacaaggttcctgcaagccagcagggccactctgtgcttggcctactgcagctcccctgcagctcctttcctctccctccccggagcgctctcctctctcctctcccctctcttctctctcctctctcgtctcctggggcatcccgggtggagggatgtaggggtcgctcctcggtgccaggccgggaagcagctcaggcctcccaagagcttggcgctcagtctgggaaaaggggttcctctggcctcagggacgttctccgcccccaccccaccccctgggagcctgaaccatctggaagggatcttagtcgggggttgggaggagagcccgtggataggaggagggggcgattctaggccgaatccagcccctgaggtgtcacttttctttcctgcggcccgtcaccgctgatagatggggctgagggcagaggaaggaaaaagaaaacctccgaggtcagtgcggggcgaggtgagcccctcccagggccctctggcccaggaggatgaagcgcgccggcttcgctcttgcacgccggcttgccatccgggtaagcgcgggaaaggcggccacagggcgcggcggcagcgcagcgcgtgggatctcacgacccatccgttaacccaccgttcccaggagctccgaggcgcagcggcgacagaggttcgccccggcctgctagcattggcattgcggttgactgagcttcgcctaacaggcttggggagggtgggctgggctgggctgggctgggctgggtgctgcccggctgtccgcctttcgttttcctgggaccgaggagtcttccgctccgtatctgcctagagtctgaatccgactttctttcctttgggcacgcgctcgccagtggagcacttcttgttctggccccgggctgatctgcacgcggacttgagcaggtgccaaggtgccacgcagtcccctcacggctttcggggggtcttggagtcgggtggggagggagacttaggtgtggtaacctgcgcaggtgccaaagggcagaaggagcagccttggattatagtcacggtctctccctctcttccctgccatttttagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacct

SEQ ID NO: 113 - DNA, 2000 bp, Homo sapiens
cactcccccgccgcctccgcccctaaccctcggccccgtgcgcgagcgagcgagggagcgaacgcagcgcaacaaaacaaactagtgccggcttcctgttgtgcaactcgctcctgagtgagtcgggggccgaaagggtgctgcggctgggaagcccgggcgccggggacctgcgcgcgctgcccggcctggccggagcctgtagcccgggggcgccacggccgggctcgcagtccccccacgccggccccccggtccccgccgagccagtgtcctcaccctgtggtttcctttcgcttctcgcctcccaaacacctccagcaagtcggagggcgcgaacgcggagccagaaacccttccccaaagtttctcccgccaggtacctaattgaatcatccataggatgacaaatcagccagggccaagatttccagacacttgagtgacttcccggtccccgaggtgacttgtcagctccagtgagtaacttggaactgtcgctcggggcaaggtgtgtgtctaggagagagccggcggctcactcacgctttccagagagcgacccgggccgacttcaaaatacacacagggtcatttatagggactggagccgcgcgcaggacaacgtctccgagactgagacattttccaaacagtgctgacattttgtcgggccccataaaaaatgtaaacgcgaggtgacgaacccggcggggagggttcgtgtctggctgtgtctgcgtcctggcggcgtgggaggttatagttccagacctggcggctgcggatcgccgggccggtacccgcgaggagtgtaggtaccctcagcccgaccacctcccgcaatcatggggacaccggcttggatgagacacaggcgtggaaaacagccttcgtgaaactccacaaacacgtggaacttgaaaagacaactacagccccgcgtgtgcgcgagagacctcacgtcaccccatcagttcccacttcgccaaagtttcccttcagtggggactccagagtggtgcgccccatgcccgtgcgtcctgtaacgtgccctgattgtgtacccctctgcccgctctacttgaaatgaaaacacaaaaactgttccgaattagcgcaactttaaagccccgttatctgtcttctacactgggcgctcttaggccactgacagaaacatggtttgaaccctaattgttgctatcagtctcagtcagcgcaggtctctcagtgacctgtgacgccgggagttgaggtgcgcgtatccttaaacccgcgcgaacgccaccggctcagcgtagaaaactatttgtaatccctagtttgcgtctctgagctttaactcccccacactctcaagcgcccggtttctcctcgtctctcgcctgcgagcaaagttcctatggcatccacttaccaggtaaccgggatttccacaacaaagcccggcgtgcgggtcccttcccccggccggccagcgcgagtgacagcgggcggccggcgctggcgaggagtaacttggggctccagcccttcagagcgctccgcgggctgtgcctccttcggaaatgaaaacccccatccaaacggggggacggagcgcggaaacccggcccaagtgccgtgtgtgcgcgcgcgtctgcgagggcagcggcggcagggggaggaggaggcagaggcggggtggctggaccctcggcatcagctcattctcccctgctacacacatacacacacaaataatgtttctaaaaagttcagttgcgactttgtgcctcgcctgtcctgttcatcctcgtcctgggccggggaatgcttctgggggccgaccccgggatgctggctaattgctgccggcgggttccgtcgccggtgtgaccctggacggcgcggacggcgtacagggggtcccgggaggggcagtggccgcggcactcgccgccggtgcccgtgcgcgccgcgctctgggctgcccgggcggcgcagtgtggacgcgg

SEQ ID NO: 114 - DNA, 800 bp, Homo sapiens
ctgaaaagccgtcagggaaaccacacatgttcaacccctggcggctcccccaaacctctcatttccagtaactgtgtgtttccgctcgtcaacagctgaaaccgagcggaacttggggggccccaccacgcggccctgctgtgcggcacggggctcatctgtcccccggctgcggggagtcagctctcaccgcccacctccttcccagatagtctctgtgcccactcgacggcccggcaagcccagcccctgcctgccacggccacagcagcctcagagagctgccctctctggccagggtcagggcctgagctgctgcctcccgcagggtcgagggcaggacacttgtctgaggcttgggtggggcaatggcacctcctcagggcctcagcccccgggcaggctcggtgaccatgggcctacagcagggaaaattctgggccaaaagctccagcctcctactagggcatctgtctgcaaatgcaccttaacctgaccgcttgggctgtgggggagcctgtttcagggaaagtgagggacgcgccagtttcctcctttggacttgatgaggcacgaacgcatctctaataaagccaggtctccccgccgtggctccctgggcgggtgcctgtggctcgggccatgagtcacgctgggtaaccccactacggggaagagggcaggaagctgggagccaccgcctctgtgcccggttgtcatctcggcacgagggcgaccgtcggcttcgtcctgccctcatggctgagggcttttgggatgtggcgggagacgggggagtc

SEQ ID NO: 115 - DNA, 500 bp, Homo sapiens
aaatcatcagaatggctaaaatgaaaaagacagacaacagcaagtgctgacaagggtgtggggcggccaaatgctcctgcactgctggcaggggacctgagaactgcagggcattccctggcttcctgcccctcctgggactggggaccccccagggacagcctaagggaactgcatttatcttcacgtctgccaaaagataacacgaagatgttcaaagctaagcccccaggctggtaagagctccaaggcaccagcagtgtgtgcagaactggggggagtctgttctcccagggatgctcccatcacctgctgccagcagtggggcatgccggtcccctggggtgtggccaaggggctgtgtctcctgcccgggctgccggcccctctcaggttcactttcccatctctaagcccacgtctcgctgcagttcaagtttgccaggccaccaacgggtgacacgcccggcgcagtgggggactccgcactttctgcgcac

SEQ ID NO: 116 - DNA, 1200 bp, Homo sapiens
accctttgtgcctgggtcccataaacaatgtgctttttaaaggggagccccctcccagctccggcctttttctccagcgtgggcagccaatcagctgcgcagagctgcatagctggaccgctttccattctgagtagcaacaacgtactaatttgatgcacacatggatgcctcgcgcactctgcaaattcatcacccgcatcttgcattagtcatctgacggactgccaagtgtttcattttctttccatgtgactttattattaccacctctctcctctcttccaaaaacctcccaaaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatggtgcctccgctttgttttagttcatcaaatttctacgactcattaggcactttgccactgctcttcttcctcctccttccgcctccccgctcccccacccccactattttttcttcctgtccctcatcgtgccgccctaactctggctcccggttccgtttttgacagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggtacagagcgcggggcgggggtcgccaggcgtccaggtgggcgtcgcggggcactggggctgtccgagcccccagcctgcaggaggaagggcgggtaggcaggagggctggaagcagccggtgctggcggcccctgtgctccaggggctgctcccgactcctccccgcacccccgcccgcctgcccgccgggacaggttggaggcgggagagagggaccgaggcagggcgggagcgcagaggctcggtc

SEQ ID NO: 117 - DNA, 800 bp, Homo sapiens
taacaaataagccgcccgtggtccgcgctgtgggtgacccttggcgccttcgaggtctggagccctagggtaaataaggaaacggggcgcctctagagttttaaatgaactctgttattggaagcttcagtagggaccctgaaaacaattaacgtcttaattagcattttaatgtctccattattacggcgcgggctctagctcagccctttaccttaccttctcaccgttaacaggggagggggattgtatttttagttcatctttttatgtttttgagttgttatcctgtctgtctgattccagcctcgagggtttgatgatgcggcccgagcctggctgtggtcgcctgtcggggctggagcgggaccctcagccgggccgggcctgggggctaacgttttcacagtgcgccctgagtttccttgggttactgctgggaccgcgcaggaggaagcaaagagtttttcgagctagaccaacaggaaacacattgacggaaatgttgccatagcccatggggtggctttaactggccgcccccgcgggctgggtgtgaaatcagaggaggccgcggctcccccggccaggattggaggctcctcgcgcaacctaatgcgggtgtccgggcccgagcgcttcccgcgcagccaggccttgtcggtgcagcagccccgctcctccccaacacgcacacacccggtgttcgcaagtgcggctcaccaagggagatccaagggggcaaaaagttatgtataaatccgagagccactggggaaagagggtcgtggtattgtaag

SEQ ID NO: 118 - DNA, 500 bp, Homo sapiens
ctaccctgtgctatcctgagctgtagtcttctgaaatgatcgtttggcttcccagccaaggcagggctcccccaaagttcattcccactcttgcagtttcacctcgggatgcttccgcagaatttcagcgcctaagcagacaaggtcaaagtaaaccgcttcaccgctgcttctggcgcaggggcccagagcgcgtgcagctccccagcacagaccaacagcaggagaggggtccgggcgggagccctgggctgtagataagcaaaacgcacccattttctctcctatttactccagaggcacctctcctcccccactcctggcatctctttatcactggctccctctccctgtggcatatttttgggtagtagaatgctgaggtcacagggagcggctctttatccaagcagtggggacatcagcctggagccctgagcatgaaccagcaagatgcagactctcgctcttgactttgggctccaggagctgccccgacc

SEQ ID NO: 119 - DNA, 1100 bp, Homo sapiens
cagtgctccgctccgggaaattgcatcgtcacgacaaacgggaccgtgataaaacgaccctttccgtccttatttgtagatcactcagacgagattgaactgcacttgtttccccttcgaggggagccgcgttttcagggtagccgaaggcttggggctgagggggggccctcaccaaggcgcgggtgggggccggagcctcaactcgatgagaagtgacaggcgtttgggggatctgggctccggccgggaccagcgcaagcagggactttgcggggacaccgcttctccaacagagcaaggcctggcccacgtttccggtttctcctaacttccttttattgccttcctttgcttcgcaagttccatctacccctccagctacagagccccacctctaggcacaggaagcttcccggaaaaagaaaggctgtcccagaaagagaccgagagagactttccaaacttcgggcatagccacggcaattcccagtctgctaatgccaaggcgggcgcgtaaggccgcctaaatctagacctccctcctcactcatttcaaaaaataacaacgtgccagccacctccgcagataccgccggctggtgcttgcccaggagacgccagggccagagcgccactcccagcatcgaaatggcagagagaaagcgcagctccaaattccccttcagaggttaagcctcaatcattgtgtcccttccctagggactgctggcgctctcgcccactggcgatgattatgcgcctagaactcgaccgcgaagcaactaataggaaaacatatggtgtcaatttggatgctccgcgcctcgcgcacacccgggaacgagcggcacaaagccctgccggccggcccgcgaccccgcgcccctcggggcctgccagccgggccgcagcgacaaacgctcagggctgcgcgccctggctggggcccgcccgagagacagcctgcggctggggagtctgagctccaaggggagagcccagccgccgaaggcgagcctaccggccaagccctggggtccggcaggttctgcacaactactcccgcaaagctcgccacctttgtgccctttcctcag

SEQ ID NO: 120 - DNA, 500 bp, Homo sapiens
gggccctcgcggctcaagcgccagcgctggagagagagtctgagggtaccacgggcgtgctggcctgggtgctcactcccgccctccttcatgagcggctttcctctgggtgtgtccagggcatcacagagctcttctgcccaaacccggaggcctaccagggcctgcccaccttgcctccttccacactctctgtagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcagtgagtgtccgctgcccgcttgctgaactcggcaccatgggcggccgccacgggtgtctctgggcacttccgggccatccctgctgctcagctcccgataatggtgtcacggtgactcaggcattagc

SEQ ID NO: 121 - DNA, 600 bp, Homo sapiens
tgtttacggaatcgggatcgaggggccgataagtagtttacacgccggccagagcagagggctggaggtcggagttgggggctggaggaacgggtggcgtttttaggattcagtaacaggatcacagctttttcttgtggtggaagctattggaatttggggagggtagcacgaggggtcctgcagctccgcgtgtgaaaaagcgtttaggtaggcgatgaaagtagttgatctgagccatggcaggcgagccccgaatttttgctgcttccccctgaaagtgtttctttaggaggagaggacttgggccacacaggacccggtcctaagagagcgattccgggaagcggacagatcgaagagaccttctgggcgaagcggcagggcagcctcgcggggctgggagtggatctgaggtcccgacccaggcggctcggagtgctccaggagccacctgggtctgcgggcgcagcgcggcggggcgggagcggtggcccgcaggggccgcggcctgcgatgaaggccggggggcagcgctagcagcgaggtgccacagtgggccgaggagtctgggctgtggcccagggtaggaccggctca

SEQ ID NO: 122 - DNA, 150 bp, Homo sapiens
acctaaaccaagctctccctccctgccgtctccttccctggcctgggtctgaaggagaggaggtgcccagaagttcagagcggcataaccacagagatactacctaattaacataccagaagcataaagaactcatttgcattggagagt

SEQ ID NO: 123 - DNA, 900 bp, Homo sapiens
ataactacgggggtgggggtggggaaggaagagatccaaggaggcagaaggctgcggtcaaaatattttggggtggcagagtcacgtaggatgtggctgtgggttctggcagcccagagattcagctcccgcctcctccctcagagcgagtccatagctaccctcacgtcccccgtggcggtcctcgccacgctccggagcgggttacccatgagggtgctagacctgggcagcgggaacctcgaagaggtggagattgcaggctgggactccagatttcgggcagggatgcggggaagggaagacgcctcgctggaggcggaatggagggcaaggcgaaggaggatggtgcaggaaacggcgacaaggcgcccggccaggcccgcgagctaccgagacccgggttccaatcctccccccttccgcaaacgcccgggttcgaggtacctggcgggcaagggccgcagcggagcgaagcgggctggccatggggaggctgcggggacgcggggctgcagagagcggcagtggcacggagcgcgcggctggaagcgaaagcaggcggtgtggccaagccccggcgcacggcccatagggcgctgggtaccacgacctggggccgcgcgccagggccaggcgcagggtacgacgcaacccctccagcatcccttggggaggagcctccaaccgtctcgtcccagtctgtctgcagtcgctaaaaccgaagcggttgtccctgtcaccggggtcgcttgcggaggcccgagaatgcgcgccacgaacgagcgcctttccaagcgcagatatttcgcgagcatccttgtttattaaacaacctctaggtgaatggccgggaagcgcccctcggtcaaggctaaggaaacctcggagaaactacat

SEQ ID NO: 124 - DNA, 600 bp, Homo sapiens
cagtccagccgcttgcctcacttcttcccgcttgccttatctccccgcagacgtggttcccctgcagcccgaggtgagcagctaccggcgcgggcgcaagaaacgcgtgccctacactaaggtgcagctgaaggagctagagaaggaatacgcggctagcaagttcatcaccaaagagaagcgccggcgcatctccgccaccacgaacctctctgagcgccaggtaaccatctggttccagaaccggcgggtcaaagagaagaaggtggtcagcaaatcgaaagcgcctcatctccactccacctgaccacccacccgctgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgc

SEQ ID NO: 125 - DNA, 1500 bp, Homo sapiens
caagatcgactttcttaggaagggggagaggagggaactcttcacgaagggaggtgggagtccacctcagacctctattggaaggaaatcgagttgttccgggggactgaggtctcttgcataaggcatgggatccttattattattattattatttttaaatcccccgcggaggagctctgggcaaatgaataccgaggcgccgctctagctggttaggcttgggatgcgataactcagtgccctcttgcagacttgcatagaaataattactgggttgtcgtggaggggacacgagacagagggagttctccgtaatgtgccttgcggagagaaaggtccaagaatgcaattcgtcccagagtggcccggcaggggcggggtgcgagtgggtggtggagtaggggtgggagtggagagaggtggtttctgtagagaataattattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttgagttgcaaaacgtaccgcgtagacgcccctggtggcgccgagagaagagctaggcctgcccagcacagagccggagagcgtcgggccttccggaagggtaagttctccgccaaggggtcccgagggagctggacgtctgaatctggacttgcccccagcttcggggttcgattctgggttttgcgcgtccccaacccccagggctttccgaagcatggcctggctccaggcccggtcctgtaaggactggaacggcagcaaaatgtgcagggaggcagtcggccggcagagctgcggcgggagccaaggtcaggcccgcggggagagcgggcagcttccagcgccggccacaagctcccaggccagctgggccgcagacccctttgcttccagagagcacaacccgcgtcctttctctcagccaggctgcagtggctgccccgagcttcgctttcgtttcccaagctgttaataacgatatgtccccaaatccgaggctcgtgtttgctcccagatgccaagaacgcaacccgaaatccttctcccaaaccctaggtcgacgagatgagttcctacttgacctctgagccgaggtgggccggaaaccgaggcctaggccccgccggggctgcaaggaaaaggggaaactccgagcgtagcgtcttttccttgtggttcctttctccggcatcccggactgcgggccctgcagccacctggaccggcattcaaaggattctgcaagtccagcttcacagactggctttcccagacgctccgaagcccgcaccacgaacagaataaaggagagacgagagatcgcaactagatttgagaatcctcgttcttttccccaatcgttcgggcagtaaactccggagccggctacagcgcgcatcctc

SEQ ID NO: 126 - DNA, 500 bp, Homo sapiens
actgtcctcctccctcaattgcctattttttgcccatagctctaacttaaccctgtgatcaccccagatcgctacttctgacccccatctcctctcccacaccaacctccagcgcgcgaagcagagaacgagaggaaagtttgcggggttcgaatcgaaaatgtcgacatcttgctaatggtctgcaaacttccgccaattatgactgacctcccagactcggccccaggaggctcgtattaggcagggaggccgccgtaattctgggatcaaaagcgggaaggtgcgaactcctctttgtctctgcgtgcccggcgcgcccccctcccggtgggtgataaacccactctggcgccggccatgcgctgggtgattaatttgcgaacaaacaaaagcggcctggtggccactgcattcgggttaaacattggccagcgtgttccgaaggcttgtgctgggcctggcctccaggagaacccacgaggccagcgctccccgga

SEQ ID NO: 127 - DNA, 900 bp, Homo sapiens
ctcagggaatcacatgtccgcctggcctggcctggtaccaaatgtttatagacaggacgagggtcgctggaatcgcctcgctcctttcagcttggcgctaaggcgcgaatctcgatcctcctagtatttctctggcgtctgtctctatctcagtctctgcttttgtctctttctccctccctccgccccagtctttccgtctctttttcctcgaatgcacgtggaattcggaattgaaaattgaggtcagaatctccctttttcttccagttatccgcgccgctgccccacgcctagcggcttggatctgcatagacatctatctacccgcaacaagatccgagctgcagaagcaaacctaatctgtctccgcaccatcccctgctctgtagacccactgccccatcccacgccacatccttgaggttcaagtagcgactccagcggatgattcggagaatgccctgctttccaaaggccccaacccgtgtttttattttctttttcctttgcccgcttgaccaactttggtttctttcagggcccggaggtgcctgcgccgcgcttggctttgctttccgccgccccaggagacccgggactgtggtttccgctcgccacatcccagcctggtgcgcacacaagagcctggcgagcttccctcgcgcgcttacagtcaactactttgggcctcggtttccctgctccttgtagatcagagaagggacgggcgaaatgcctgcgagggagggttggcgaatgggttggttggtggcaagactgcagttcttgtacatggacgggggttggggggtcaacactggaagaactcctgcctgacgccaagagccacccgctttccagctcgtcccactccgcggatgtttacccaccttcatg

SEQ ID NO: 128 - DNA, 500 bp, Homo sapiens
tttggggcacccaacccttcccaagcctcggttttcccgatcttgtgggatccttgcggcgcgaatggggttggaagcaccttggaagctacagagtaccgggtcgggacaatttccggcactgccccagttcagtggtttatagaaaatttctttctctctctcaggtccactaagaccgagagagagagagaagtcgactctggcacacccgggcgaggggctgccgggattcgggagctggcgcggttgattttttccgagaatcctccacttggggtgacgtcgggcagcgcgcgcgggccgtgaggttaatgcccaggcttttctctaaagcgtccgggaatgatccggcgaataaaacgggtgtctgcaaagttaatgaattgtacaaggaggctgagggtggggacttcgacccggggagccagaggcggttctggtggacgcttccccgtgcgcctaggggtgcgctgggctttcccagccgaggtctgcag

SEQ ID NO: 129 - DNA, 2000 bp, Homo sapiens
ccagacagttaaggtaaaacgttgaagtcaagaggaagtagtgagtctgttgccaactggatagggttggtcctgtcccatctaaatgtattagaattaagtggcttttaaaaatgagctggtcatcttcagcccacgggctggccaatttggaacttaatgggcctttgcgtcctccttccctgagcctccttttattccagacttctcagtgtgagtctgtgcgtccctccgacgatctcagggagtggggtgccttcatctgcctgttccctgttcctcaggctgacgctcccgctgtcctccccgcctcccctcactccttttctccctcccttcctccttgtggggaggctcttggccagggtccctgagcccgggcgggtgctggcagaggacgcagaaggggtgaggtcacgtctcccttgagccccgagccgctggcttttcagagcctcgccacaagccggcggccagagccccagaccacacagaccgtgcgctcctccgccctcccggcgccgccggcctcgcccatgtctcagtacgcccctagcccggacttcaagagggctttggacagcagtcccgaggccaacactgaagatgacaagaccgaggaggacgtgcccatgcccaagaactacctgtggctcaccatcgtctcgtgtttttgccctgcgtaccccatcaacatcgtggctttggtcttttccatcatggtgagtgaatcacggccagaggcagcctgggaggagagacccgggcggctttgagcccctgcaggggagtccgcgcgctctctgcggctcccttcctcacggcccggcccgcgctaggtgttctttgtcctcgcacctcctcctcacctttctcgggctctcagagctctccccgcaatcatcagcacctcctctgcactcctcgtggtactcagagccctgatcaagcttcccccaggctagctttcctcttctttccagctcccagggtgcgtttcctctccaacccggggaagttcttccgtggactttgctgactcctctgaccttcctaggcacttgcccggggcttctcaaccctcttttctagagccccagtgcgcgccaccctagcgagcgcagtaagctcataccccgagcatgcaggctctacgttcctttccctgccgctccgggggctcctgctctccagcgcccaggactgtctctatctcagcctgtgctcccttctctctttgctgcgcccaagggcaccgcttccgccactctccggggggtccccaggcgattcctgatgccccctccttgatcccgtttccgcgctttggcacggcacgctctgtccaggcaacagtttcctctcgcttcttcctacacccaacttcctctccttgcctccctccggcgccccctttttaacgcgcccgaggctggctcacacccactacctctttaggcctttcttaggctccccgtgtgcccccctcaccagcaaagtgggtgcgcctctcttactctttctacccagcgcgtcgtagttcctccccgtttgctgcgcactggccctaacctctcttctcttggtgtcccccagagctcccaggcgcccctccaccgctctgtcctgcgcccggggctctcccgggaatgaactaggggattccacgcaacgtgcggctccgcccgccctctgcgctcagacctcccgagctgcccgcctctctaggagtggccgctggggcctctagtccgcccttccggagctcagctccctagccctcttcaaccctggtaggaacacccgagcgaaccccaccaggagggcgacgagcgcctgctaggccctcgccttattgactgcagcagctggcccgggggtggcggcggggtgaggttcgtaccggcactgtcccgggacaacccttgcagttgcgctccctcccccaccggctcacctcgcctgcagctgggccacggaactccccggccacagacgca

SEQ ID NO: 130 - DNA, 600 bp, Homo sapiens
ctctctgggccttaggaaaatggaaatgacacctgtacctgcccttccaggactgacaggaggggctgctccatgaaacctcactgctgcggtcataatgtcattatcttttgccttaaagggatttcttctgcaccagcacctaaagtggcagccccttacccttggccatcagctggaccctggtgctctcctggagcccaaaacctctgttttgtgttgcatcctgctgaccagccacagtccacacccatctgagtgtctgagcagaacagcccagaggccacaccaggatggctttccaccggtcaccttcccccacccactcataaaccctgcgtctctgggggagagggtggcgaggtcccctccccacatagatggaaacactgaggcctgattcatggtgccccctgtgaagcgcctcatggccagcaccggggggcagcaggccagggcggggacacatacccggttctcgtcgtagatgatctgcaccaggctgcggtgcttcgactcgatgggcggcggtgacacgggcttctcaggctcgggcggcttggcagcctcctcctccagctgttgctgtggggagaggca

SEQ ID NO: 131 - DNA, 400 bp, Homo sapiens
cttgaaaactcccagccccctttgtccagatggggatggaggtggccaggctgccccgttgattgtgtgccgaggagccctccccgggaaggctgtgatttatacgcgcaggcttgtcacggggtgaaaggaagggccactttttcattttgatccaatgttaggtttgaaagccacccactgctgtaaactcagctggatccgcgggccgtgattaaacacattgcccgctttgttgccgagatggtgtttcggaaggcgctgtgaatgcacttccctttgcggggctcacacagacaagatgtgtgttgcaaggatgaggcgcctgctcggcctccagcccagggccgggaagggagaaggtgctgtgcgtcgctgcctgtgtcgcccgcggctctcc

SEQ ID NO: 132 - DNA, 1200 bp, Homo sapiens
cgcgtcagggccgagctcttcactggcctgctccgcgctcttcaatgccagcgccaggcgctcaccctgcagagcgtcccgcctctcaaagaggggtgtgacccgcgagtttagataggaggttcctgccgtggggaacaccccgccgccctcggagctttttctgtggcgcagcttctccgcccgagccgcgcgcggagctgccgggggctccttagcacccgggcgccggggccctcgcccttccgcagccttcactccagccctctgctcccgcacgccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgagcgccttctccctggctttctgcgcgctacctttcatgggcttcgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaattgtgagtccccgggccccgaggcagcagggcactgagactgtccggccgcggatgcggggcgggaagggtgga

SEQ ID NO: 133 - DNA, 2000 bp, Homo sapiens
cttccgccgcggtatctgcgtgcccttttctgggcgagccctgggagatccagggagaactgggcgctccagatggtgtatgtctgtaccttcacagcaaggcttcccttggatttgaggcttcctattttgtctgggatcggggtttctccttgtcccagtggcagccccgcgttgcgggttccgggcgctgcgcggagcccaaggctgcatggcagtgtgcagcgcccgccagtcgggctggtgggttgtgcactccgtcggcagctgcagaaaggtgggagtgcaggtcttgcctttcctcaccgggcggttggcttccagcaccgaggctgacctatcgtggcaagtttgcggcccccgcagatccccagtggagaaagagggctcttccgatgcgatcgagtgtgcgcctccccgcaaagcaatgcagaccctaaatcactcaaggcctggagctccagtctcaaaggtggcagaaaaggccagacctaactcgagcacctactgccttctgcttgccccgcagagccttcagggactgactgggacgcccctggtggcgggcagtcccatccgccatgagaacgccgtgcagggcagcgcagtggaggtgcagacgtaccagccgccgtggaaggcgctcagcgagtttgccctccagagcgacctggaccaacccgccttccaacagctggtgaggccctgccctacccgccccgacctcgggactctgcgggttggggatttagccacttagcctggcagagaggggagggggtggccttgggctgaggggctgggtacagccctaggcggtgggggagggggaacagtggcgggctctgaaacctcacctcggcccattacgcgccctaaaccaggtctccctggattaaagtgctcacaagagaggtcgcaggattaaccaacccgctcccccgccctaatccccccctcgtgcgcctggggacctggcctccttctccgcagggcttgctctcagctggcggccggtccccaagggacactttccgactcggagcacgcggccctggagcaccagctcgcgtgcctcttcacctgcctcttcccggtgtttccgccgccccaggtctccttctccgagtccggctccctaggcaactcctccggcagcgacgtgacctccctgtcctcgcagctcccggacacccccaacagtatggtgccgagtcccgtggagacgtgagggggacccctccctgccagcccgcggacctcgcatgctccctgcatgagactcacccatgctcaggccattccagttccgaaagctctctcgccttcgtaattattctattgttatttatgagagagtaccgagagacacggtctggacagcccaaggcgccaggatgcaacctgctttcaccagactgcagacccctgctccgaggactcttagtttttcaaaaccagaatctgggacttaccagggttagctctgccctctcctctcctctctacgtggccgccgctctgtctctccacgccccacctgtgtccccatctcggccggcccggagctcgcccacgcggacccccgccctgccccagctcagcgctccctggcggcttcgcccgggctcctagcggggaaaaggaaggggataactcagaggaacagacactcaaactcccaaagcgcatgattgctgggaaacagtagaaaccagacttgccttgaaagtgtttaagttattcgacggaggacagagtatgtgagcctttgccgaacaaacaaacgtaagttattgttatttattgtgagaacagccagttcatagtgggacttgtattttgatcttaataaaaaataataacccggggcgacgccactcctctgtgctgttggcgcggcgggagggccggcggaggccagttcaggggtcaggctggcgtcggctgccggggctccgcgtgctgcgggcggggcgggcccggtggggattgggcgc

SEQ ID NO: 134 - DNA, 1000 bp, Homo sapiens
agtttggggagccttttctccatttgagaaaaaacaaacttacagcgaggggtgaggggttagggtttgggattggggaaaatgtgggtggggagcccccccaaggaagtgaggagggggctgcaaggattacacctgggcatacgtttccctagaaatcacattcattgtatttttataatttattctaaatctttcatgcgaagaaagtcagtagtgagtgttagtactggtggccctcctgatcacacttgcatctcttgagtgtgccttaaaggtcttgggaatggaaaatataaaaactgcttcgtgatgcgtcatctttatcccccactcccccacccattccaatatattttctacttccagcctaaattcggggccccctaccgaggccggccatgatcttgagggcggcataggggaggccgcgctctgtccaccccagcctggtgatgccgttcgcttcttgtgcccggtattgtgggctacatgcctttccggcgtacggagctgagcgtccaggccagtgcccctcaacctctcagtaatgtttacccgaggccgtcgtgcaatgagactattcgcatggcattgtcaacgcggcggcgcgcgcgtctcggccctccgcggcttgccagactgtcctgcaaaccacctcacccgtctctttggcgcaggagactcaggctgtaaccggagaaaacacttcaccctggaaccctaactcaggtcctggcaaaagatgcgagaggaagacttgctctcttaataaatctcggccgcccgcacatctggcccctagacctgctcggtagaggactggctggtggatgcgcggtccaggccgtgggcactcgacccacctctattttccttcccgaggcgcccctggattaccactttcggtttgcgcttacatccgggatgtcgaatttcccagggaatcataattattttatctataatttattctaaccccaaggttccaagaaaatct

SEQ ID NO: 135 - DNA, 1100 bp, Homo sapiens
acattccttctaaaatgtgggctttctgtgtacatgggcgcgcattcccaggactcggttccctgggtggaattcacccaggaatacaatcgattttctgaacctgcgtaaggccacaggcagctctgaaaatgaaagcgtttgctaagtgggggagatctcaccgatcgaacgtttaaaaatggctttgtcttcattcagctctcccgatttattctgtgttttacaaatagaagctcagagcttctgtcgcccagtccttgcatgactcatggcggtggccacacgggtttcagggataacgggatgtttagaaaatcgctgcatatcggagtttcctagcacgttccatttatactgaacgcaggcggccgctgaaaatccagcctcgactcttgctaatgactgggtaggaccctcggggtcctgcgacggtgctggagggtgttcccggctccgatgtggggaggcctgcgcggggactaggttctcgagaggcgagcgggcgcgccagagaacccgagactgctgcggggccggatgcgggatccctgggctgcggttctacgcagaaacgccaatggccatgcctccccagctcctcccagccccagtcactaggccggcgcctggcccggagatcctcccagagccctggcggtgccatcatgccggagaagacaagctcggccccgctggaattcgctccaaacacagatgctcatttttggaatattctagaaaaataacaagatcttgtttgtcgttatgattcacgggaggtaactgatgggagggccatttacatgagggcagacactgtggggcgaaggtgacttctggacgtaggctttaaagtaggaacggctccaaattcccaatatctccggccttaccggttgcaaatcggacccctgcgggaaaaccagacacttctgtttcgtggctttcgggctgcctccagcccacgcaggctcgtttagtccccgtggagtcagccccgagccttcctagtcctggaacaagggctccaggtcgcggccgcgggaagccgccaagagggcggggagtagggattccctccagctccgcagggcatc

SEQ ID NO: 136 - DNA, 1500 bp, Homo sapiens
tcctcctcggcctcagatgtcgtcccacctgcccacgagcagggaacctggaacccactctcccggcagtccccagcgggttccgccacccggcggccgcccctgacaccgagtgggtgggaggaagaggcagctggcggggatgggccattgagacctcttgaaaaatattaaaagacaggatgggtagagatttctccgggagaaagttcgagggtgcatcgggtcgcggctgggaggagtacccgaaatgccagcaggagaaatgcaacctgtttaggccacaccttcaatccccgaggctgtctggagagactgcgtgcgggggacttgccggcgttcccacaccgcgcctgcaatccactcccgcggctgcctggcctctgccactcgcggcttgaagccagtggctctcaagccctcggccccgcggcggcccgcgcagccttcacccggcgccggcaccacgaagcctggccgcagtggactccccgcagctcgctgcgccctggcgtctcccgtcgaggagggagggacggaggcctgagccgggagctccctggcggtggtcgggccgccccccttgaggcctgctcccccctctcggcctcgccaaatccctgaaagcccagtcccccttcgtcaccccgggggcttctaatcactcggtatcgatttccctaactcttttcatcctgttgaagacacatcttaaaacactccagcccggagtgtgctctgggctttatccacactaataaaatgatttacccttctctccgcgctctcctcacagaggaaaatcgttcgagccccggctatttgtgtgtgatcagtaaatatttagtgcgctgacatccttagctgggcttcggatcgattcggggcccaccgggaggtgcgcacggtccgggcggggccgcgccgagctcgccgagggggctcctcccgccctcgccgccggccgctgatttacggcccctgcaaccagctaaggggggcgaaagcgcgcctggaaaattggcttttcaaccttttacttttgacattcagccacttccccaggctctaattctcgcccgcactcctccctcccgccctactaagggttgccctgtgcgccctgcgagcccttccagcagcaacgcgcggcgctcgcgccccctcggcccggggaccacctatcacagccctgagccgcgacgcggggaggccccggcccctgctatgggggtcgcctccttcgaggagagatgctctccgcccgcccacacctctgagggaggagagggggtggagaagcccagagctgcatctgctggatgacgagccgctctccctgctaccctttctccgacccgtcggcctttctcctactctggagactgatcctcgacgtccatcgggccggatggcgtcgggtggaagcgttactttcctcgcagaaaaactcctcctctttcctaagatcagaaaaagcgcttagcttggaattgttag

SEQ ID NO: 137 - DNA, 600 bp, Homo sapiens
cctaggcattctcagcccgttttgctggagggggcatttgaggcctggccagcttagccagcctacaaggagtgttactggggtgaaaacagccagcggggaccagtctgcttgtggcccgccaggtgcctgggatggggaagcagcaaatgcccaccttcctgcccaaccccctcctccctcttcatggggggaactgggggtggcagcggctgccgggtgcgagcgggctcaggcctgtggccctgcctgacgttggtccccatcaagccatgtgacgagaccaggccacaagaaagaggtttcaacaagcgttatcgtttcctggaactccaactcggcgacttccccgaagaccggctgtgcctggcgggcgggctgcgcacagcggggacaaggctgcccccttcctcctccgctgcctccgcggccgcgtctatctcagtctgactacctggaagcagcactccaccctccagcccagcggccctcggctcagctgccaggtcaccggcaaccccgggagcggtggggcaggggctgctccgccagcctctgtgatgttcaggccgggctgcaccagcccgggacccctaggtg

SEQ ID NO: 138 - DNA, 700 bp, Homo sapiens
gcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagt

SEQ ID NO: 139 - DNA, 300 bp, Homo sapiens
tgtccgacaggcacacagagcgccgccaggcacggccctcattcttcaccccgagctcccgcaaggtcggcgaggaggctggagcagcgggtaggaagcgggccgaggctcccccgacgctgggccgcaactgtcatcgcagatccctgaaaaacgagctctgtaatcgttgccgtcagcgggtgtacaattgcagccttatgtttcctgccgctgtttaccttcctgagcggcgcccagagatgcacacacgctgccctgaagcgggacgtgacctctgggcacctgtgaggtcctggg

SEQ ID NO: 140 - DNA, 500 bp, Homo sapiens
gtcggctcctgcgctcccaacggggtggccgtttccttcctcgcaccctcttctctcccggtgcctgcggtcccaccttccagatacccctcggagagtccagctgagctctcgccagagctttccccttccaacccgctcgacttgcccagatcccaagctgggcttctctctccatcgccccagaaagtgggtcttggagaccgaggcaagaatttgggcctccgcttctgttccagaccccggaccccttgccaaaatgcggcagatgtgcagattgggccgcgcttggttcctggctgggtttatggagcctgcggctgaggcaggctccgcagaccccgagccagagtgggatttaacggcggccggtgcgctgtgcttggtcaaccccggtaaccgtcacgctgctagtgatatgaaaaaaacctgccagcgttctgcttttctgccccgctgcagtctttagcacccgccaggattctgtccgagtgtttgga

SEQ ID NO: 141 - DNA, 1000 bp, Homo sapiens
tttagtgtgtgcataaaacatcccagctaatctcaaatagacttttcctgagcagaggctgaaatttgcaagtaatgcaaagaagactccgggagagcgtcgccgatggtggagcgggagacgggcgtggggagccccactgcagtgctgggatcgaagtggtgctgaccccaagacctctcccctcctcctcccccgggagcttctccagggttatttgggaaatgagggggaactccaatccctgagaaagcgctcaggggcttgctgaggtgagcgcaaatggaagcacaaggccgggctggccgtgggctcagtaaccagtcggctgcccggcttgcgccagcactaaatgctcgatcagaaagagaaaaagaggcgcaataattccaaatttcaggaaaagtcaaatcggagaggggggacgcaggtctcttcagactgcccattctccgggcctcgctgaatgcgggggctctatccacagcgcgcggggccgagctcaggcaggctggggcgaagatctgattctttccttcccgccgccaaaccgaattaatcagtttcttcaacctgagttactaagaaagaaaggtccttccaaataaaactgaaaatcactgcgaatgacaatactatactacaagttcgttttggggccggtgggtgggatggaggagaaagggcacggataatcccggagggccgcggagtgaggaggactatggtcgcggtggaatctctgttccgctggcacatccgcgcaggtgcggctctgagtgctggctcggggttacagacctcggcatccggctgcaggggcagacagagacctcctctgctagggcgtgcggtaggcatcgtatggagcccagagactgccgagagcactgcgcactcaccaagtgttaggggtgcccgtgatagaccgccagggaaggggctggttcggagggaattcccgctaccgggaaggtcggaactcggggtgatcaaacaa

SEQ ID NO: 142 - DNA, 500 bp, Homo sapiens
catggtgcttcaggaagggaggggacgagagccctgggcttgtggtgtccacgtggacagctaatgaggagccttgccgatgaggagcatgcgttcccgacggggcggccgaatgcggaaggagccgccattctctccgccctgaccgcgggattctctgcagcagatgagaaacggcgctgactcagcagggtccctcccaggccccgagcggtcatctggtgacccccgcgcttcccccacggcccagccggagaagggcaaagggaagtcccggctccaaggcgcacccagagatgcggtgcatgtggcaggatggcccagccccgtcggcagccccagcttcctgcccctggtttccttcctcccacgggctacaggcctctgatgagctttggaaagcaggaaacacacaggctagtaactatgaatgggtccaaaaaacactccttattactttaaactacttaggaagaagcacagcgttgccaaacgccaga

SEQ ID NO: 143 - DNA, 1200 bp, Homo sapiens
gcgcggggggccggaggatggcggcctgggggccctgcgggggctgtcggtggccgccagctgcctggtggtgctggagaacttgctggtgctggcggccatcaccagccacatgcggtcgcgacgctgggtctactattgcctggtgaacatcacgctgagtgacctgctcacgggcgcggcctacctggccaacgtgctgctgtcgggggcccgcaccttccgtctggcgcccgcccagtggttcctacgggagggcctgctcttcaccgccctggccgcctccaccttcagcctgctcttcactgcaggggagcgctttgccaccatggtgcggccggtggccgagagcggggccaccaagaccagccgcgtctacggcttcatcggcctctgctggctgctggccgcgctgctggggatgctgcctttgctgggctggaactgcctgtgcgcctttgaccgctgctccagccttctgcccctctactccaagcgctacatcctcttctgcctggtgatcttcgccggcgtcctggccaccatcatgggcctctatggggccatcttccgcctggtgcaggccagcgggcagaaggccccacgcccagcggcccgccgcaaggcccgccgcctgctgaagacggtgctgatgatcctgctggccttcctggtgtgctggggcccactcttcgggctgctgctggccgacgtctttggctccaacctctgggcccaggagtacctgcggggcatggactggatcctggccctggccgtcctcaactcggcggtcaaccccatcatctactccttccgcagcagggaggtgtgcagagccgtgctcagcttcctctgctgcgggtgtctccggctgggcatgcgagggcccggggactgcctggcccgggccgtcgaggctcactccggagcttccaccaccgacagctctctgaggccaagggacagctttcgcggctcccgctcgctcagctttcggatgcgggagcccctgtccagcatctccagcgtgcggagcatctgaagttgcagtcttgcgtgtggatggtgcagccaccgggtgcgtgccaggcaggccctcctggggtacaggaagctgtgtgcacgcagcctcgcctgtatggggagcagggaacgggacaggcccccatggtcttcccggtggcctctcggggcttc

SEQ ID NO: 144 - DNA, 600 bp, Homo sapiens
gggcgggttgccacactgtcccctttctgcatgggaggaagggggctcgagaactgagtcagccacacaaaacgaggatggacagaactcctgagtagcgagggtgcctgccgggcgcgaggaggagggggaagacgaggaagacgaggaggaggaatagggagcaccacatgacagaggggctgcctcagaccacaaagcgcttcctcatcctttcctcgccctttgatgccgccggcaacgtgactctgcgagcagcggggcagacgccaggtctccctcgcaggcgggaaaggggctccaaggcgggtgctgccttgctcgggtcacatggctacgtgggggccttgctcaaattcacttcctgccttcattacaaaactgtcaaaggggatcgcacgtttgcagggtgtcacccaagcattctggttttgcaaacgacgctgtgcggcaggcggtctgatacctgatgagctcggtgtggcggggtcggcagcatttcctccggggttttgagctctggccacttctccttttgttccacccaatctcacccacttctgggcttcgaggccagagtgtcttaacaagggggcacgt

SEQ ID NO: 145 - DNA, 500 bp, Homo sapiens
gagcgagactttgtctcaaaaaaaaaaaaaaccaaataaattgaaagctgagaaattcagagcacaagaagacaagcgcgccccctcttttagctgtcaacatggcggagccgtccctggtgacgcagcctccaaaggcctccctgtgccctcctgagaccgcaagagggaaagtggcagcgacagtgatcgtggtgtctttgtggcggttgtgttgacctcactgacccccgaagtgccgctctagggtctgtcctcagcggtgacccggccgggtcgaagggcagagttccgctgtcactagccctccacccgtcctgtgtgctgggatgccctcgcggcgccgtccacgccaccgccgccccctcttgtgggttctgtctcctccgtgtctaggatcctcctgcatccgtttttccttcctcccttctctccctccgtctgtcttgcccgcacctgaggttgtcgcagaggcgctgagacgggccagcaggagctgt

SEQ ID NO: 146 - DNA, 600 bp, Homo sapiens
tgctgtcccggtcctgtcgcagtcctcaaagatgctagagtgacagtcctctaggggtagagatggtcgtcctcccaggagaaggtggcccggagacttggaggtgggatcaatcctgccagtcctggatcaggaggcctctgtcgggcgccgccccccttcctcctccatcagcaacaggcggcgccggccagcctcatagtcagcctcatccacactgaccagcaggcgaacagcctcccggcccacagcctctcgcagggcctcagtcaggaacacgccccgcagggcctgcagcagggcgccactcaggtagtcgccccagaaggcgtccagataggagagctctgagaacttgatgtcacaaaccacagagcccaggtcccttgagcgcagcactgcggtggcctgcccaaacacgtccagctgccgcgccagcgcctggggccgccgggatgccacgccctgctccaaggctggcccatgctcgcagtactctgctcgaacccggagccggatgtctgcaggggaaggagggatttgtcagggagggggccaacactagacacacttatggggaacgccacccttcctccctcc

SEQ ID NO: 147 - DNA, 500 bp, Homo sapiens
tgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagctccgggagcacccatcgctcaccccgcagcttcctggccaagaagctgcagctggtgcggagggtgggggcgcccccccggaggatggcatctccccctgcaccctccccggctccaccggccatctcccccatcatcaagaacgccatctccctgccccagctcaaccaggccgcctacgacagcctcgtggttggcaagctcagcttcgacagcagccccaccagctccacggacggccactccagctacggtgagggcctgggccatcttggcccacttttcaga

SEQ ID NO: 148 - DNA, 110 bp, Homo sapiens
tttgggccacgaggcaagttcaaagcgggagacttttgttttataaaatgatggtgagcagctccggttttatgtcaaacatcagggtttcgtgcaggatataaacattt

SEQ ID NO: 149 - DNA, 800 bp, Homo sapiens
tgcctgagcgcagagcggctgctgctgctgtgatccaggaccagggcgcaccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggtcgggcagctgggctcgggcggcgggagtagggcccggcagggaggcagggaggctgcagagtcagagtcgcgggctgcgccctgggcagaggccgccctcgctccacgcaacacctgctgctgccaccgcgccgcgatgagccgcgtggtctcgctgctgctgggcgccgcgctgctctgcggccacggagccttctgccgccgcgtggtcagcggtgagtcaggggccgtctccccgaagaacgagcggggagaggggaccacggggcgcggcgggcagcctgttctcgggcggaggctctccggggcgttggaaacctgcatggtgtaaggacccgggaggaggcggggagaaattgattgtgctgttctcctccctctcttctctaacacacacgcagaaaagtttaaatttttgtgaagcgcttgcttacgtagctgcggagcgagcctctgcttcattacgagcggcatagcctttttcaggagtgatttccactttctttgtgagagagttgaccacac

SEQ ID NO: 150 - DNA, 600 bp, Homo sapiens
ttcaatttacactcgcacacgcgggtacgtgggtgttcggggtagggcactgatctggggaaggtctcccccccgcgacccaactcatctttgcacatttgcagtcctccctcggtgcactcctggcggggatctggccagtgcagcgcactgggaccgagggcagagcccgcggagtgaggccaggagagacttcaggcctctaaggacacagctgaggctaaggctgagttgaacgcagcccctcccgcggctcgtcccctctccagtgtctctcccgtaaggtgccgctcccaacagcaatgggtcgagatgtagaggaaacactctgtacgttatttttccgcccaccctttagcgcctgaggagacagacagtgtagactttagggtacaattgcttcccctctgtcgcggcggggtggggagcgtgggaaggggacagccgcgcaaggggccagcctgctccaggtttgagcgagagagggagaaggaggtccacggagagacaagaatctccctcctcccacgcccaaaaggaataagctgcggggcacaccgcccgcctccagatcccccattcacgttgagccggggcgcg

SEQ ID NO: 151 - DNA, 1400 bp, Homo sapiens
gcctgaagaccatttcttcctctcttagggacctgctggtctccagctgattcggtccaggaggaaaaacctcccacttgctcctctcgggctccctgcaaggagagagtagagacactcctgccacccagttgcaagaagtcgccacttccccctccagccgactgaaagttcgggcgacgtctgggccgtcatttgaaggcgtttccttttctttaagaacaaaggttggagcccaagccttgcggcgcggtgcaggaaagtacacggcgtgtgttgagagaaaaaaaatacacacacgcaatgacccacgagaaagggaaaggggaaaacaccaactacccgggcgctgggctttttcgacttttcctttaaaaagaaaaaagtttttcaagctgtaggttccaagaacaggcaggaggggggagaagggggggggggttgcagaaaaggcgcctggtcggttatgagtcacaagtgagttataaaagggtcgcacgttcgcaggcgcgggcttcctgtgcgcggccgagcccgggcccagcgccgcctgcagcctcgggaagggagcggatagcggagccccgagccgcccgcagagcaagcgcggggaaccaaggagacgctcctggcactgcaggtacgccgacttcagtctcgcgctcccgcccgcctttcctctcttgaacgtggcagggacgccgggggacttcggtgcgagggtcaccgccgggttaactggcgaggcaaggcgggggcagcgcgcacgtggccgtggagcccggcctggtcccgcgcgcgcctgcgggtgccccctggggactcagtggtgtcgcctcgcccgggaccagagattgcgctggatggattcccgcgggcagaggcagggggaaggaggggtgttcgaaacctaatacttgagcttctttgcaaagtttccttggatggttggggacgtacctgtataatggccctggaccagcttccctgttggagtggccagagaagtgtgtaaaacacactagaggggcagggtggaaaaagagactgccttcaaaacttgtatcttttcgatttcattttgaaaaataactacaaatctattttaattttacaaagttagactcatagcattttagatatcaatgtcttcatttaacagaagtgaagatggagcaaacgctcaatcagcgtctgtatttattcgctcctgttgtgccagggtgcgtttttgccgagcggttgcctttctttactcacaaaacccccttgatgtctgtcctccacgttttacgagggagagccggatcttttgaagtttgtatcatctaaagcaggtatattgggatgactatggatagaatttaacctgaaaacactgaagttgacagctgacaaag

SEQ ID NO: 152 - DNA, 250 bp, Homo sapiens
tgcttcaaccggaaatgtggttgaattacccttacagtgaacctgatcagtggtaacaggagatgctagaacaggaaaagacaagtttcccctttcctccctatcccatcaattactttgaggtgtattttttctttgcaacccctccagagaagtcggcaatgtttaacgagcatgcctgccaagtggcttgccttatacctcattatgaagtgatactcagggccactaacacatcgcacagcattgc

SEQ ID NO: 153 - DNA, 500 bp, Homo sapiens
tatgattccctcgatttccctcaatcttaaccattgtggatcacagcaggagggccagaaagtgagcttcagcctggcaccgggacctcagcctctcccttaaactttccctaatcctcggagctagtgttactcaagtgactccacagtgttgcccgatcccttcagacatggccttgatgatctccaaaactcatgctacctttgccagcctaaagcatccactctgtgccccaaaacgtgaatgtcaaatacccttcaaggcagaaggctatttctatttttgtttgtttctgtttaaggcaacaatcaccaacatttggtacacatgagccatcctgtgaaacatcaaggcgcttcgttggcagcaagtcaacttcggtttcagaagaaagctgcactatttcctgaggttagaggtttaaaccaaaacaagacaaccacattttaaccccaaatctgccgactgagggtaaccatgatccttccttcacagcacc

SEQ ID NO: 154 - DNA, 150 bp, Homo sapiens
tactaaatcaacccaaacccgagaacccggtcatggagaaataaatgatagtaatctatgctgttcatctgttccatcactcactcactctcttgctgaacaagaaagggccacccatgtagcaaaccacatgtaaagagccgggaagac

SEQ ID NO: 155 - DNA, 300 bp, Homo sapiens
tattattttgttcaaagtagacgggtatactaacatctgtgggcaagtttaccacacgccacttaaaacaggctaacagggtcatatgccaaaacgttcaggtttgcatttttgaaaagctcagagatctgacagatgtgttccggccgcgatttaacatgcggctccagtgagaaggaagcagatatgacaaatggttcacttatttcagaactaaaaccccagaggagcagcctgagccaaaaagggaagtgatcaatggaaaagacggtcgaatctgctcacaggcaaggcaagggg

SEQ ID NO: 156 - DNA, 400 bp, Homo sapiens
gcaggggtgactggtcctctctctctgcacctcgcaggatttctctggaagatctgagcccgagcgtcgtgctgcacatgaccgagaagctgggttacaagaacagcgacgtgatcaacactgtgctctccaaccgcgcctgccacatcctggccatctacttcctcttaaacaagaaactggagcgctatttgtcaggggtaagtgcgaccctagaggcgatcgtctctgctgtctgtggaaaaaagagctcctacacccaaagtgcttctcagttgctgacacttgatccaagctgctaatttaatctaatgtgaggctgagttttctgaatgtgggataaagtcgtagctaaacctgcttctcagggagtgccttttatctgcaatgtttttcaaat

SEQ ID NO: 157 - DNA, 10000 bp, Homo sapiens
gtctttcccgcccccttgtctaaactcaaaaccgagtccgggcgcgccttgcagggcgcccgagctctgcagcggcgttgcgggctgaacccatccggcacaaactgcgggccactggcccctcacacctgggagtttgcggcgctggcctgcagcccggggcccacgtggcggaagctttcccgggcgcgcgctgcgcagccccgcggggccggggagacaccgctcgggagtcctccgctcggctgcagaatctttatcagctgcactttaccgcagccctggctaggacgctaggcggtggagcgccctatccaggtgcgccgccgcaccatggatcaccgcgcccggtcccgcagtcccgccatggcctggggaggcccgaagcccggggacagtggccggcccatctccggctccgcggacccccggctcaggcgggagggcaggcgggtccctgcaggcccccagggagcccgggagcctctctctggcgtcattcagtcccggggcaacctgaagcgcggtagatattggagagggggcgtctgttggggggacctggcgtcattactgatggctagcagggaggagggaacgggttgtcacctcggcctcataaggccgtgagtgagtagtccagggcctcttcaggcatttttgaaactggattaactaggggggaaattgtagcactgaagccaccgtgactgtcttttgcgctgtgtggaaactccggtaaaactctttgggcaacagtcttatcaccagctcttcaacgtgtgcagcccttctggtcctgtccctgttctgggccccaggaatgcaaagcaggtccaggcactgtgaagaccctggcggtggaggaagaggcttcccggctgtggaggaagccagacccttacaacacaagacgagaaccagacctgcgtgggggagctctggatgctacaggggctcaaggaggggtggaggggccttcccaggccaacccctgaacggcttggacaagatgctcagatggacgggaggaacggcgtgtgggatgggggagctggaggcgggtgggtgggggggggaggatggggaaagcgctggcccacccagtgtgggaggggtagaggaaaagcccgcaggggccaggttgggaccccgtaggccgggttagagggcttggacttgatcctgacaggcgacagggagacatattgctacttattatgtgcacagtggccagatctctaaagaaaacaccatcccccacccccaccccccatatagtaaaccaggtggtccgcccagtgctcccagggaggtgatgggaaatcccactccataccctgcggtgaggggttccatgccctccacgtgtgcaactactccgggcccagggaaacactgggccccatccggtaacccccggcccagtcgggtttcccagttcacattataaccaaacggtcttgccagctagacagacagacacccctgacctgtttaccctgatcctctgctctcaggattaatcacaacttgtcgaagggggtggcttccagtggggtggaccgctctgtcaatgccagcgtgtgtctagcatctcctggggtgggggtgtggggaagggaggtgtaggatgaagccctagaagcctcaggcaattgtgatccggtgggctggatactgaagcccacccctgccttgacctcaattttcagtatcttcatctgtaaaatgggaacaacctgccttcctcctagccctaaaggggctgctgtcaagattggctgagatagctgtttgcaagctgagctcaatgaaagttcattgtgtccccctcagtcctatcccaatatcgtctcactgcaaaggtggggggcagcttaacttcaagggcacttcaaggatagccaggtggctgtcagcccagctttccaggatgggagcaggatcttgacagaagggttgactgggaggggcagttgctggtttgggcttcgttaggttgcatttttgtttgttgtcctttcatttccctggggcagcaccccttcctgcaagctccaggccttcctctggaatgctcctagagcccaacctctgctggtgcctgagcttaagccaggccagctaaggggatcctggattcacacggcctcacagtcactcagattgttagcagaagacaaaaattacaaggggagggcgtcatgtgattcttacacaccctccaaatccagcagacaccttggaagccacaggtagcttcaagaaacccattttacggatgagaacctgagatggagaaaggacaactggagatctctgagtctctgagcccacactccctacctccctgcacctccaggcactctgctggcaggatcttgggcaaatgcccacagctctctgagagtcagttttcctgtctgtaaaatgggagtcataccttcctcctatggccggtgagagactaaattaaactatgtctgtcaagacacctgaaactcctggcacaatttaggttgccttcaagtggtcacagttgtcattaggtggaagtcaacaccccaatcattgtaaaggtgcccatataccccaagatccagattacagctctcacagtttattatatacagcgaaaaaacacataacacacctttgcccacatttacatgtattttacggaccatgtttcacatcagtccgcatgcacatctgcacgtgtgtgcattcggcagtatttaccaagcacctgccaagtgccagggcctgtcctccgcacccggcgtgaactgtcctggaccagtcccgggagccgcggttctgaccagccgtgctgaccctggacgactccatgagctgttttgtgagaaagacacgccatttgtttgcagagttctgacttctgaggggtcatgtagcacatgtttggtagccaaacgctgtcattcacgaccaggagcgatggctgcaatgcctttttctttgctttgctttccggtgccgggagccttgcctcccgccgccacccctggtcagctctgcgcaagaacgtcgttctgtttggcagccaggccgagacgcagcctgaatgtgagcaggaactcggagaagggaagggagagaatcagaaagaaggcccgggagggacccgggaagcagtgggaggtctgcgccctggagccccgcgagagcccgccggtttggcacgggctcctcccgggccgcccggcggtccaacaaaggccggccccgacacgcacccggtcttttgtgggagagaaacacaaagaagagggaaaaacacggaggaggccaacagcaccaggacgcgggggccaaccaggaactcccggagccggggcccattagcctctgcaaatgagcactccattccccaggaaggggccccagctgcgcgcgctggtgggaaccgcagtgcctgggacccgcccaggtcgcccaccccgggcgccgggcgcaggacccggacaagtcctggggacgcctccaggacgcaccagggcaagcttgggcaccgggatctaatttctagttattcctgggacggggtggggaggcataggagacacaccgagaggtactcagcatccgattggcaccagggccaagggagcccaggggcgacacagacctccccgacctcccaagctactccggcgacgggaggatgttgagggaagcctgccaggtgaagaaggggccagcagcagcacagagcttccgactttgccttccaggctctagactcgcgccatgccaagacgggcccctcgactttcacccctgactcccaactccagccactggaccgagcgcgcaaagaacctgagaccgcttgctctcaccgccgcaagtcggtcgcaggacagacaccagtgggcagcaacaaaaaaagaaaccgggttccgggacacgtgccggcggctggactaacctcagcggctgcaaccaaggagcgcgcacgttgcgcctgctggtgtttattagctacactggcaggcgcacaactccgcgccccgactggtggccccacagcgcgcaccacacatggcctcgctgctgttggcggggtaggcccgaaggaggcatctacaaatgcccgagccctttctgatccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaagtgctagcatccgagatctgcagaaacaaatgtctgaattcgaaatgtatgggtgtgagaaattcagctcggggaagagattagggactgggggagacaggtggctgcctgtactataaggaaccgccaacgccagcatctgtagtccaagcagggctgctctgtaaaggcttagcaattttttctgtaggcttgctgcacacggtctctggcttttcccatctgtaaaatgggtgaatgcatccgtacctcagctacctccgtgaggtgcttctccagttcgggcttaattcctcatcgtcaagagttttcaggtttcagagccagcctgcaatcggtaaaacatgtcccaacgcggtcgcgagtggttccatctcgctgtctggcccacagcgtggagaagccttgcccaggcctgaaacttctctttgcagttccagaaagcaggcgactgggacggaaggctctttgctaaccttttacagcggagccctgcttggactacagatgccagcgttgcccctgccccaaggcgtgtggtgatcacaaagacgacactgaaaatacttactatcatccggctcccctgctaataaatggaggggtgtttaactacaggcacgaccctgcccttgtgctagcgcggttaccgtgcggaaataactcgtccctgtacccacaccatcctcaacctaaaggagagttgtgaattctttcaaaacactcttctggagtccgtcccctccctccttgcccgccctctacccctcaagtccctgcccccagctgggggcgctaccggctgccgtcggagctgcagccacggccatctcctagacgcgcgagtagagcaccaagatagtggggactttgtgcctgggcatcgtttacatttggggcgccaaatgcccacgtgttgatgaaaccagtgagatgggaacaggcggcgggaaaccagacagaggaagagctagggaggagaccccagccccggatcctgggtcgccagggttttccgcgcgcatcccaaaaggtgcggctgcgtggggcatcaggttagtttgttagactctgcagagtctccaaaccatcccatcccccaacctgactctgtggtggccgtattttttacagaaatttgaccacgttccctttctcccttggtcccaagcgcgctcagccctccctccatcccccttgagccgcccttctcctccccctcgcctcctcgggtccctcctccagtccctccccaagaatctcccggccacgggcgcccattggttgtgcgcagggaggaggcgtgtgcccggcctggcgagtttcattgagcggaattagcccggatgacatcagcttcccagccccccggcgggcccagctcattggcgaggcagcccctccaggacacgcacattgttccccgcccccgcccccgccaccgctgccgccgtcgccgctgccaccgggctataaaaaccggccgagcccctaaaggtgcggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctggtgagctccccgtggtctccagatgcagcacatggactctgggccccgcgccggctctgggtgcatgtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataacctgttgcatgagagcagaggggagatagagagagcttaattataggtacccgcgtgcagctaaaaggagggccagagatagtagcgagggggacgaggagccacgggccacctgtgccgggaccccgcgctgtggtactgcggtgcaggcgggagcagcttttctgtctctcactgactcactctctctctctctccctctctctctctctcattctctctcttttctcctcctctcctggaagttttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcatcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgacccccacctccgggaaaagattctaaaaacttctttccctgagagcgtggcctgacttgcagactcggcttgggcagcacttcggggggggagggggtgttatgggagggggacacattggggccttgctcctcttcctcctttcttggcgggtgggagactccgggtagccgcactgcagaagcaacagcccgaccgcgccctccagggtcgtccctggcccaaggccaggggccacaagttagttggaagccggcgttcggtatcagaagcgctgatggtcatatccaatctcaatatctgggtcaatccacaccctcttagaactgtggccgttcctccctgtctctcgttgatttgggagaatatggttttctaataaatctgtggatgttccttcttcaacagtatgagcaagtttatagacattcagagtagaaccacttgtggattggaataacccaaaactgccgatttcaggggcgggtgcattgtagttattattttaaaatagaaactaccccaccgactcatctttccttctctaagcacaaagtgatttggttattttggtacctgagaacgtaacagaattaaaaggcagttgctgtggaaacagtttgggttatttgggggttctgttggctttttaaaattttcttttttggatgtgtaaatttatcaatgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactgagtgttgagattttaaataaaatttaaagtaaagtcgggggatttccatccgtgtgccaccccgaaaaggggttcaggacgcgataccttgggaccggatttggggatcgttcccccagtttggcactagagacacacatgcattatctttcaaacatgttccgggcaaatcctccgggtctttttcacaacttgcttgtccttatttttattttctgacgcctaacccggaactgcctttctcttcagttgagtattgagctcctttataagcagacatttccttcccggagcatcggactttgggacttgcagggtgagggctgcgcctttggctgggggtctgggctctcaggagtcctctactgctcgatttttagatttttatttcctttctgctcagaggcggtctcccgtcaccaccttccccctgcgggtttccttggcttcagctgcggacctggattctgcggagccgtagcgttcccagcaaagcgcttggggagtgcttggtgcagaatctactaacccttccattccttttcagccatctccactaccctcccccagcggccacccccgccttgagctgcaaaggatcaggtgctccgcacctctggaggagcactggcagcgctttggcctctgtgctctttcct

SEQ ID NO: 158 - DNA, 100 bp, Homo sapiens
tttttaatgctcagagaagttcgtattactgattcgggaacactgagtttttcagctcctgtaaaactattttcaggtttattttcaagtacattcttta

SEQ ID NO: 159 - DNA, 400 bp, Homo sapiens
caccctagaggcaaggacggggtctgtgtcaagaggcttcccagagaagtgaaaactctgcaggtgcagccgctgggagagcatcaagaagggcagggtggaggggcagggggcgaagggagggggtgaagcccgcaccctacccccacatgaaactgattccactaccccatctctgcaagcgtccagaggcagagaggccaacatttcggggacagcttggaggcgggagatttaggcagggctccttaaacttttatgtgcatgaaaatcaggccaatcacggggctcttgagcaaatggggacgatgattcagcaggtctgggctgaggcctcagattctgcacttctaacaagttcccaggtggtagtgatgctgccagtccaaagaccacactg

SEQ ID NO: 160 - DNA, 5000 bp, Homo sapiens
tgcttcagtggggtaaacttgaaccgctgagaagacaagcagggagtcggtctcgctgagatttttacctgtggttctaggaacgcagaggcatgtgagtgttcaggctttgcatagaccactaagccacttctaagaacaaggctacctgagccattttgcaaaaatatgtacgtgccgaggcttttcctccccacacctacctcaactctttctgccgacacactgcacttttcaagggaacccaagtttgggttcggcaagaattgtacgttgcacaccgtgtgtgataattccagggaatttcaatcgcatcttgtcttccttcctaagcaaattcggtgggaacctggtgtggtgtgatagaaaaagccccgagttctctgtggtagaccacatcaatttcatgtgccagtctctcagactccggcttgcctctctcaaggaagggaacaatggtttgcttggcttcactcctctctttccccccaatttccacatgggtatctggctaaaaatgagttacaggtttccttctgtgagaattgcatggactgataaagtaccatcccaggaagaaaacaaagatgctgtcttccctttcggctcacagttgccgttggggagggaacacacgctgtaaattataggcagccagaagtgaccgcattgaccactgcgagtggcccagctatggcaacaggctgagaactctgggggagagccatttgttggcagggatggtgattcttctagcatcaagctctaagatgatgaccaaacggtatcaaaagaaatgatattttgctacctctccggcttgggtgaatgatgtggacagttaacctggacaatttaaacctttatgttgatggatcacttggatgaaattaaccaggaaattgccaagatttcacttggccctctgacatcaaatctcaatattatattaccaaattagagattctaaagaaccctgagttcctttcactgaaaggaaggagtggaaaaacctttccagatgatcccttttgagtcttggtgcgagctcaggccctccctacactgcctccgtgaaagctaaccgacccttgttcctaacctagcgcaggtcagctgagtgtccatcgggcacaggagccctgggcttgtccgggagatagccagactcctgctatttcctgatgtctgcatagctcagcgtgtccctcaccatctttgccgttggccagtaaggagagccccaggggccagcactgcacactgaaacccaacctattgctcaatggaatgcttaaaaatttcctgaatctgccttcctgagttgataaaataggaaacaatacacgttctgagggggtactgaaagcagagtaaagccaggaagatcttttttttctgttattctatacaaatattgcttcctctgcttgttagcagcccagaggaaatgcagccagggagccgtttgcagcttttcaccagtggccggtgtctctgtgttaccaaccaaacgacgctgcaagactagtgactaacgcacgtctgcatgattcaacttcactaaaattccctctgctgccagtaaagaagcacttgaaaactctttaatttgaaacttgagcttggttaatgacttgttttcttctctttctctttaacttctctcttgccatctccaacacacacacacacacacacacacacacacacacacacacacacacactctctctctctctctctctctctctctctctctctcatcaagttttttaatttcagggacccggaaacatacagccccgtgcattcacaatagcatttgctgtgataaagtggccggcaagccctctgcattcccctgctcacttagctgtatgaataaataatgagtcacagatacaatttgggtgctcaagagagtttgtagccagaaaattaattattctcccatcccagcccactccatctcagctttgccaaaccatcaagatacactttgcaggcactggtcagagtgcgtgccccgacgcacacggcaatgcctttgagacattttatgttattatttttgtttgtttaagcacagccctcttttaccacgaaagatacacaagacgcacatgcacacacatactcacacactcacagctcaaccacagctttgtccatttcaagaggctggtttcaaaaatggagacaggttttccaccctggctgttcctattcataagcctgtaatctaacgacttaagctgcgagaatgcttaactcgggaaacttctctattgcccttttccagagagacctcggtatgccacaatttgcttcctttctctcttgaaagatgctggttgtctctttgcattgaggctacaaggaaaaacacagcacagccccatgctgatgattttaacctaaccaagtctgtcagtctcctgtactctctgccttatagagacagctgccttgccactttggccctgaagtccccaggctggtgcaaggctatctgagagcctccgcctcctgccccacactggcaccagccctcctggctggctctgtgcatgtgcctgctaagccccagggcaggctgcattctgggccacacagcatgccgagttaaggataactcagacacaggcattccgggcaagggacagcaaaataaaacccagggagcttcgtgcaagcttcataatctctaagcctttaaacaagaccagcacaacttactcgcacttgacaaagttctcacgcaccgactgaacactccaacagcataactaagtatttattaaaacatttctgaagagcttccatctgattagtaagtaatccaatagacttgtaatcatatgcctcagtttgaattcctctcacaaacaagacagggaactggcaggcaccgaggcatctctgcaccgaggtgaaacaagctgccatttcattacaggcaaagctgagcaaaagtagatattacaagaccagcatgtactcacctctcatgaagcactgtgggtacgaaggaaatgactcaaatatgctgtctgaagccatcgcttcctcctgaaaatgcaccctcttctgaaggcgggggactcaatgatttcttttaccttcggagcgaaaaccaagacaggtcactgtttcagcctcacccctctagccctacatctctctttcttctcccctctgctggatacctctgggactccccaagccctattaaaaaatgcacctttgtaaaaacaaatattcaaattgttaaagattaaaaaaaaaaaaaaagccagcgccgccttggctgtgggttggtgatgctcaccacgctgcgaaaccctgtggtttgcattcagtgtgattcgtcctgcctgctgaccactatgctgggttcagacttctgacactgccaggctacccaacttgtggttctgtggttgtttatgaggcccaaagaagttttcacacaacccaaattacaaatttaactgttcccctttccacagcccatctcaattggttcttgccaatcatgtgacttaagtgatgtcaatttttttttttcttttctgagcaatgcccttccttccctccacctgccctcccccaggctgtgcaagaaaatagccgagtagactttgcaagagggggggatgtagaaaaaagtgactcagtcacttattatatctcaatggtctttgctgatttagtacaactcggctcctgttgttatttgtggtttttggaactactgattattttgataaagatttcattgctgcttattcaatagtaattcaacgctggcatcaagccgctgctccgacaggatgtggatcccatcatttaaaatgctaggcatcagctccgggagagttaagtccttggtaacgtctatcatggcataagtgaaactataaaagggaaaaataaataaaaagaaatgttttggtgagagtctgacccctacaacgggctggcaactcacaggtattttaaagcctgggaaagggaaagaattttacttttgaaataaaaggactgttttaatgaaaccaaaattatgtggttttattccccctaaatggacaactttagtatgtatctctttcagtaaagagataaaatcatagtacagtcttaacacacacacacacacacacacacacacacacacacacacaaattaggaagctaaaggaaaacaaagcagagagaatttctgtatttgggacaaagcagtggttactctgcagatgtttatttgtattgtcacttgggaaagctccctgtattgcctttctctagttcaattcaaatcaataggctaatttacacctgtaggtaaaactacactttgagcacatgaggatgccacaatagaaggggaaccaggaggagacacttctcctggggctgactaatgaatattatatagcgcgtcctctaccttagaaagacatgcctgtttgaagatgctaaaaacaggataattttgtaagtgggcaaaccactgtggtcacacgtatttcattttccggccccactggctttacctgctgacaactaaaacgtcattttgttttgtagttccaagatgaagaaaggcttattttcctgatttactaccttattcatttggctctgctctgcctacatccgccatagcactctgcgcacgtgaaatttcgacacatagggtcaagagaacctgtgtgatgatgggttgtaaatgccagtcctggattctaagctgcagtagccagcacaggcacttcagaaaggctgaactcccacaacactccctcggttttccctcatccacttaatttcacacacacaaagacccacaacgatagtagcttccatggcacaagtctttcaaaaggaacagacacaatttttacttactcctgttttgactaaagcaggaattgaaactcaacagaccgctttctcttacacttgtgagaagttagctggccacatgt

SEQ ID NO: 161 - DNA, 500 bp, Homo sapiens
agggaaaagagataacgaaagaaagaaagaaaaaaaaaagggccggcaatttcatgtacatttgttttggcattcgctgaattctagagatgaaaacaatctcctgcttttaattcagtccacgtgcaacaaagttgtacgttgggagatctggcttttaataagaacgattaacaagcgtttttgatcacaggaagttgagaagagtcgctgcttctaagaatacaataaacattgactagcagttagacggtccatctttctctatcagccgtttagcagcctctactttgatttggggcaaatgcgagatgggaccaggagagagctccccacacccccaccaccacgtgggcagtggttctgttccagagcgccttccttcctgtccagggaggcaggctgctgaggccgtttctgggcaagaggccattgtcgggatatttgctttagatagcttgcagctgggctgagtgggtgtttcattcagactcaacaca

SEQ ID NO: 162 - DNA, 700 bp, Homo sapiens
agcctggcgcacccgccctaatttgagtcagggaccctaggcgcctgcagctccggttcgggttgagtgcctcctgtcaggatgtgaagctgctgtcccccccgggggcctccagcactgctgaggactcagcagtcagcctctcctcccacttgggctcatttacagagagcatctccaggaatcagtcatggggaaaggggaaacgcggagtgacaacacaacacgtagaaagttctctgccgccttggtcaggcttgtcagcctcacagcccatcctgctcctgcgggaggaaaagtgagcagaactcagcccggagatgagccgcaggccggcagcccctgcctctgccctgcttgttgtgactgcaatgcaaggctctctgtaggtgcgggggattcgggttaaatgggtctccagtggtccagcgctcccagcaaaggccgaccacaagaattagcgggctagttatttaccataaccatatacaaaaccacaagcatcagcgttccctcaaatacatccgagacgctgtatatctctttattaaagcctgtcagggtttgttattgcacagcttggccttgaaccccaactaaaccaggctgcttgagcaaagaaccaagcaatgcaagcattcaggcaggaccattataaccctgaggccaaaggcagaagcagggagaggagacgtcttcc

SEQ ID NO: 163 - DNA, 500 bp, Homo sapiens
agaccagcctcggtcttcggcctgcgggttctgcaaagtcaggctagctggctctccgcctgctccgcaccccggcgaggttccggtggggaggggtagggatggttcagccccgccccgctagggcggggcctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccc

SEQ ID NO: 164 - DNA, 17000 bp, Homo sapiens
cacgcgccccggcctggctggaggggccaacccagcggggcccgcctgcccgccggcctttctgtaactttctctctttaaacttccaatgaatgaacgtgcctcttcttacggatttgtttagattagggaatagattcctcgctgatagcgttgctttgcaaataagacctcctatattattcaaaccaaacgagtttgtgtctttaaaggactatagcagccccattctatgttaagggttggctattacaattattatatgcttagggaaaaaatgtaagccccgtagtttgtgcttttcttgatgtacagaaaggtttatcttaggtggataggttttgttttgtttcttaaatgggatttttttggttcgtgtctttgaagggctgtttcgcgacgtcattaatgaactaatcggttttcagatttcaagacggtgtgtaattgatgtaaccactgaggaatttcagtgcacaccagactaagactcttccagcgcaggggattccagatgcttcttgggccctctggaagccatggggatgtttccagaccgaaaggagggctttgctggggagcagatgtgctgcctctccccgacccaggattttgaggccatgtttccgttaatctggaccgagagccctctgggagagggaggcaggtcgtagggggcgggggtgagggggagcgagatgaggtcgtcgctggacgctgggctcccttgtcgttgtccttttccccagaatccatggtcaggcctagggagccacccctgggtgctcgagatgagtccccaccctcactgaaggtcggtcactggatgtttgtgtgcatcgtaaggggcccaccgaagtcccgaagccttctcagggaccagcgagaaagaggagcaggcttgggagacagggaaggaaaatgcaggggaaagggctcacccctcgaccccaggtaaaattagaaggaacgtgtggcaacccaggtgcagctttggtcgctcgctcaaggactttgctagtcactaccattaattaattaatcactatcattaactaccaaggacaccgtttttattcccctaaaagcgtcaccttgaggggaatggagaattgggcagcagctatgcaaatcctgggacaggagacactgcctgaggaccctctctcactcccaatcccagaacccgaagttatccccgacaaccaagtccaagcacatgaaccaagacgatcagcttcaggcagctccttacccccacaagcggcccaggaggtgggcattatcccccacccctgggatttctccatccctccctcttctctcctgcgggagagagagctgtggtcacccagttgggcgcgatggctctggactaatggggtctctagacccagggcacaaaggccaatctgccaggggttactgcatgtaatgagataatcagacatgttgaccaacctaaaagaaaagactctcccagggagtaactcccagtgaaataatttattaaaaaaagcaaaaaagagacataaatttctctctactacttgaggaaacagcaaacagaacgaattagggtcttggcctctgcaggaataaattatttccgacttggtctggatacctgtaattatttgtaagctgtgggtagtaatactgtaattgtcccccggtcctttctggaagtagcaatgaccccaaggacaattggtgacgtctccacagggtttacacatggaaaggagtgaaaaatcgaggaattctttcagatagcccagaccaaaaatcctctcagccatgaaaaggtcatatatgtgatgctgggccaagcggacttttctggagtaaccatatcataactgattgcggatgtagacaagagcgtataaaccaaataggcttgaatcaacgcagtcctggattttctgttgcctctgcttgctggggcagtggaagttcttaaactccacttcagaggttggaaattcttccccctcccccacctccttagtgacaaggtctctgatctcctgctgccactgcaatagcctctcccatcccgcggggaacggccggagttcttcccttgatctctcccgagtcggcttccgctggggatggatcgcaggtaggcgccggcgcggcctggggaagaacagttgcggagcatctgaagcggaaaatccaagcagatgtgaggcgatccgggcccgcctcgttcctcttggggcctgaatttcttccagataagtttcctaatggaacatttctaagaggtggggtacgaggcggcttgctcgcacgcgcagtgggacagactgcgggtggggacgtactgagaggtccggacctcaatgcgtccgacccgtctccacaccgcccttttccagcccccagtctcctttcattccctactcttcaggctcctttggggccagtgggtgaaccgccatttagaacggtgcctcggactcgggggtcgtgcgctccatctctgcctcccccctggggcccgcgaggctggtccgggctttctgagctgggcgttcggctttaggcccaatacctggaccaggaatttcttctccccgcgccagaagggaaagacataggaggtgtcccaatctgcggtcaccgccgatgctcctgaccactctagtgagcacctgcccggtacttttccattccaacagagcttccagcttcatactaactatcccacatacggcctgtgggtattagctctaagtgtccttttccgagggcccgaggctccccctccagcagggagagctccgggacggcccccaccaagggttgggtttcttccttcacaattccacagaggcatccctgtccttcctacctgggaaacctcgaggtgcggtgcccgtgtacttctggtactttgcgtggtgccatcagggaccccagagccacagctgcgtgtgtgtgtggatgtgtgtgtgtgtgtgcgcgcgcgcgcgtgtacggcgaaaggatgtgcttgggggagccgagtacacaacgtctgcttgggcagctgctgggcaggcgttgggcctggaggtatctcacacccacgtatcttccagtcttcaaacacggcattgctctgcctcccgtagcgcgcttcgaacctgcctcgcggacacgtgaacagaggctgtccctgggaagataagtgcgctttcccgtaaaatccgggaaatttgccttgaggaaagtttccgttcttgttacttgtcgggtttctcccacttccacttagccatgtttctgcgatctgggtaatccctttcaagcccaggaggaattctcccgggtccataattgagggtcggaagccgtgggggtgagaaacgcattaaatcctcccgaagcccaggaggtgccagagcgggctcagggggccgcctgcggaagctgcggcaggggctgggtccgtagcctctaaccccttggagctccttctcccagaggcccggagccggcagctgtcagcgcagccaggagcgggatcctgggcgcggaggtgggtccgactcgccaggcttgggcattggagacccgcgccgctagcccatggccctctgctcaagccgctgcaacaggaaagcgctcctggatccgaaaccccaaaggaaagcgctgttactctgtgcgtccggctcgcgtggcgtcgcggtttcggagcaccaagcctgcgagccctggccacgatgtggactccgcaaggggctagggacaggcagggggagagcccgggtttgcgcacaccttccagcccctggagggagcctgctcggcttcgaacgccttcgaacttttgaccttcaaaggagtccctggaaaaggtcaggagcgcctgctgcaggcacggttgccgaaggccaggccttcctggcgcaggggagggccaggggagggaagcggatactcagtcgctgtccgacggcgagttttcggagcagcaggctcatgatcccgggccagtggcgagagcagtgacaccgagaacccaaatctccgcgcccccatccgcggcccggtgtcctcccggcccctgctgacctccaggtcacgcaccccactgctccacggctctgcagcctgtggcacacggccgagagtccccacatgatctcgacgccaaggtaaggaattgccctgcgtcctctgagcctgtctctggcctggggggccgggaaagctgcactcctggaagaggtggggttatgtgaccgccgctgcaggggtgcgcggaggactcctgggccgcacacccatttccaggctgcgggagccggacaggggagggcagaggggggacaaaaggactctttaggtccaaaatgaccctgaaggagagtccagaatgcccagtggccgcgtctgcaacggagtcttctttctccaattgccttctgccccatcaccatgggccccacctgcgccacctgcgcccaccctgtgaccctggctcagcgaccttggcccttaatcgcccaacgccgattcctcaaaattccggctgcgctgaatcgggctgcttttgccgccgccccggcagttgggccctgtttccgccggcgccctgggagaggcctcaccactcggctgggctccctggcccctcccttcccctggcctgagcgcccctgcggcctcccgctcctcctgagaaggcgacaatctctttgcaccttagtgtttcgaggacagaaagggcagaagggtcacttcggagccactcgcgccgttttcacgtgtgtgtgtaatggggggaggggggctcccggctttccccttttcagctcttggacctgcaacaccgggagggcgaggacgcgggaccagcgcaccctcggaaggctcgatcctccccggcagggcgcctggccaacgagtcgcgccgcctcctctcggccgcgcctgctggtgaccttcccgagagccacaggggcggcctcggcacccctccttccctcgccctccctgccgcccatcctagctccggggtccggcgaccggcgctcaggagcgggtccccgcggcgcgccgtgtgcactcaccgcgacttccccgaacccgggagcgcgcgggtctctcccgggagagtccctggaggcagcgacgcggaggcgcgcctgtgactccagggccgcggcggggtcggaggcaagattcgccgcccccgcccccgccgcggtccctcccccctcccgctcccccctccgggacccaggcggccagtgctccgcccgaaggcgggtctgccataaacaaacgcggctcggccgcacgtggacagcggaggtgctgcgcctagccacacatcgcgggctccggcgctgcgtctccaggcacagggagccgccaggaagggcaggagagcgcgcccgggccagggcccggccccagccgcctgcgactcgctcccctccgctgggctcccgctccatggctccgcggccaccgccgcccctgtcgccctccggtccggaggggccttgccgcagccggttcgagcactcgacgaaggagtaagcagcgcctccgcctccgcgccggccgcccccaccccccaggaaggccgaggcaggagaggcaggagggaggaaacaggagcgagcaggaacggggctccggttgctgcaggacggtccagcccggaggaggctgcgctccgggcagcggcgggcggcgccgccgggttgctcggagctcaggcccggcggctgcggggaggcgtctcggaaccccgggaggccccccgcacctgcccgcggcccactccgcggactcacctggctcccggctcccccttccccatccccgccgccgcagcccgagcggggctccgcgggcctggagcacggccgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtgaggcctcaggtgggcggccggggacgctggggagcccggcggccccggcccaggcgggaagcgcaagccagcccgcccagaggggttgccgcggcctggcgtccagagctggggcgtctgagggaggttgcgtgagggtcttcggcttcggcgctggcttggggcgaggggccagggccttggcggcccaggcgaccaaaccctctcctggtccagggctgggtgagggcgaattacgaattgttccaggggcaggcagtcccccagcccgcacggccagcgagttctttctggttttgttctttctccctttcctccttccttccttcgccagtgcattctggtttggtttggatttttttctctctttctttcctttctttctttctttctctttctttttctttctttcttcctctttctttcattctccccttccttccttccttggccccctctctccctccctccttccttccttcctttgccaatgcattggtttgttttctttccttttctgctttccttcctttctttggaagttcactctggttttgctttctttctttccccatcccttcctttctttatccctccttcccttcctccttttctttctacgattccctttatttttccttcattcctccctctttttgtctcttctggaggaggtgaaggagggtcagcttcaggcgctgcgagtcagcggggatcacggtgaggcccaagcactgcaggctgaggccacagagcgaacacttgtgctgagccgggccctctcgtgaggctggggtgcgggaagtccgggcaggagagacccgcccccgccgttgctgagctgagacccggctgaaagagaggggtccgattaattcgaaaatggcagacagagctgagcgctgccgttcttttcaggattgaaaatgtgccagtgggccaggggcgctgggacccgcggtgcggaagactcggaacaggaagaaatagtggcgcgctgggtgggctgccccgccgcccacgccggttgccgctggtgacagtggctgcccggccaggcacctccgagcagcaggtctgagcgtttttggcgtcccaagcgttccgggccgcgtcttccagagcctctgctcccagcggggtcgctgcggcctggcccgaaggatttgactctttgctgggaggcgcgctgctcagggttctggtgggtcctctgggcccaggagctgggagggctgcgccggcctctggagccccgggagccagtgccgaggtagggagacaacttccgccgcagggcgccggacggtcggggcagagcaggcgacaggtgtccctaggccgcagggcgcttccatagcgccatccccaccaggcactctactcgaaatcggaaagctcgaccttttgcgttcgcctctgccaagcctgttatttgtgctggccgctgggtctggagctgcgcttctcggcccctccccggtggagcgcagagggctggtctgcaagcgcggcctccagccccgcggctccccggcccaggagccaggcgcgggctgacccgggagcacccggcagcggagggggctggaagcggaccctaggcctctcctgtgccacccggccctaccgcgcggccgcggggcgctctcctctcgggcgcagcggtccttcagcccagggcaggttcctccctttcctactcggaacgtggcaaagataccccagtcccagcccctccagctgagagctgttgcccaaggtcgtcgctacttgtccgctcaatggtgaccccttggcagagaactagggatgattccactccggttgatgttttaggggaaattaaaagaacattcggttttctgagtctccttccggggaggcgtggtggtaactggtttgctgggaagagccgttccttaaccgcatgcaacaaagcaggtgtggaatccggacgagagggcactcactgccttctgccccctttggaaatagaaaaagccttcgaagcagcaatccaaagatcaaatgatttgcggtcaatgatttcaattaaaccagaaattagtaagggagggccgagaagacacggctgctcagaagctgttcgctgtttgagggatttcccggagagcctgttaaaagatgcgaagtggtgggtgtaccgctcagccacctttaaaccggctctgtgcgttctggctctggaaagcaagtctccaggcatttgggctcagaattgctgggccccgagtttgggcgggggtggtccttctgggggtcaggccttgagcagcttgcactggtggcaggtttgggagcagttgaggggcttcctgtgtgtcttttggagggggtgaccctggaagttggcactctggaagggagctgtttggccctagagttttggaaagggccctgaacctgttcggtccccctcggaaagggaagggagcagtggcttagtccctccctcctccattcgtgcaatgcctggggtaggggtagacctggagccggtggactcatatccttggaattcgtcaggacagctgctccggggccttggccctcagtcagtctggggctgaggagtagggaagctgggaacttggggcagaggaagaagatgcgtttagaaagacctccattatgcaaactggagtccatttatgcaaactggtcacccttccagtagctccaaagagtggcagtggagtggcatcttgattgatttaacctcttctcaggggacctgggtctgcgagggaggatatggctgcggggttggaataggatctgtctgagctgccagggtcagggtggtggccctagggaggttttagggccagggtggtcccgggctgtggcaggggctctcagatcgcctcgggctctcagctgcaaggtgaaaaataccatgaggaattgatctgccaagggcggtcttgtctcaaagcaagtggattgctggggtaaagaatctagagaccagcttaggactctgggaggaagaaaaaaaaaaaaagaatagcatagtcctaaggaactgcaaggatcaccagattaacccttcatacctggggaaattaaggccagacatgacacaggcctttcccaaggctctgtagcaagggcaatagcaggccagttgctgccactgcggtcctgtggggcatgttctcactccactgcacccaggaggctgccagcctctgttccttttaacatagatctcctcagttgttaagacagaaagaggaactcagaggggtccctgtgtgcaaggcagagggagaccaccagaaccagggtaagcaccccacttggtagccagttcaaggacttggggatgttttcaacatttacagcgaggtttgaggccccattgtcatgcagcgctactcggccttggtctccttatctgtaaaatgggcccattagcaatgcacagggttgctgtgatgaagggtgaggtcccacaagcaaaagctgtgcagtgaggggggaatcctaagcattgttcctatgccattcaccccttcctgtgagctccccatattccctggctcaaaggagtcttgaatggcagggatggaggactcactgcctggactttgaagacccctgctttctgggtgaccaccttttcttccctttgacagtgaactaatacattggaggtagatagtgctgggaagaggacaggagaccacggctgactttggacatgggctcgaaattgataacttgatgagtcttggagggtggttaagataagctcggggctggggcagcgctgaggtctgatggtcagccagccctccccaaagtgtggccctccgttctggagataggggctttggaaactgcaaaagcgtcctggcaggccagctctggttgctccctggccatagctgctctgactacaggcagcaggacgcaggtcggcctctgcccatcggaggtcagaggcagggcctccagcaccagactcagcagtgccactgcaaacctggcacaacaggctggtcccaggactcagctcagcagtgaagttggaaaccaaggttgagtctccccatctccctttccccaacccgaaagacccaagatgggtgtgggtgaaagagggagaaagaattgctactccagaaactgtcatttgcccacacgaaacgaggtggggttcaaggtctgaactcttccagtgcctgggtgcctttgggtttaaattcagctgcaggtgcccccatcaccacttccacctgagcacaccacgagaagccaggttatcttagaaactgtttcccggaatcaaagcgacttgatttggagagttgggtgaggagaaactcacccctatacccctcagggcgtcagagatgtgaggcaattctctacctccgctggaaaaaatgcagatttattaaaggtcgactgtttagcagaacaacgtagattttttacaacgctttccccgtctctgctttgaagcctgccaggctgcagctggggatccaggagggaaagcccgcaggcgcagaggggacaatccgggaagtggtaaaggggacacccgggcacagggcctgtgctttcgttgcaggcgaggaagtggagcgcgcgctgcagattcagcgcggggctagaggaggggacctggatccctgaaccccggggcggaaagggagcctccgggcggctgtgggtgccgcgctcctcggagccagcagctgctggggcggcgtccgaactccccaggtctgcgcacggcaatgggggcaccgggccttctgtctgtcctcagaatacgtaggatacccgcgggcgacaagccgggccaggctaggagcctccttccctgcccctccccatcggccgcgggaggctttcttggggcgtccccacgaccacccccttctcacccggtccccagtttggaaaaaggcgcaagaagcgggcttttcagggaccccggggagaacacgagggctccgacgcgggagaaggattgaagcgtgcagaggcgccccaaattgcgacaatttactgggatccttttgtggggaaaggaggcttagaggctcaagctataggctgtcctagagcaactaggcgagaacctggccccaaactccctccttacgccctggcacaggttcccggcgactggtgttcccaagggagccccctgagcctaccgcccttgcagggggtcgtgctgcggcttctgggtcataaacgccgaggtcgggggtggcggagctgtagaggctgcccgcgcagaaagctccaggatcccaatatgtgcttgcgtggagcagggagcggaagaggcagccggtcctcaccctcctctcccgccacgcacatatccttcttgacttcgaagtggtttgcaatccgaaagtgagaccttgagtcctcagatggccggcaacgcgccgaggtcacgctccccagaaacacccctctcccctcccctaccccagctccccctggggcgggtggtaattgggggaggagaggccgcaggcagggaaggggtgggaaagccagagagggaggcacaaagtgatggcagcccggcaaacactggggcttcgggctgggccgcgctcgtttaatcccacaaaaatcccattttggaggtgagaaatagaggttagaggtcgggcccttctggagatcagaccgaggagacgggcccagctggcgtcttaaagcaaggagggggagtcgggaggaggtgagacccctgcacccaggtggggctcccaaaccgttctggatttaccacactcccaggtccgattttccatggagggctggggttagggactggcaccttcttgttgttaaccgcatttgatattcacaagaaccctgtgaggagactttgtcaccgtttttagatgcctgaggttgccggaggggcagtgagagaatcgtctaacctggtgttcctaccacagtccaggccctgtgtcctgggctggacccacagcccctgccaccacccagaggaaggcgcgaagctggctgcctcctttacgggtctcccttaggtgccctcatgaagggggacggccacctcacagtgcaggaactatctccccgtttgctcccaaatagtcttcttggtgtggtgctgtctatggtctgtgacctgcatctggagttacccccaggaccagcttcggaagaggagggatcgcttggaggccgtgcagtgtgaggaacggcaggcagggtgtgggaccaacatgcacacactcgcaggtgctggggccagggaggaatgaggcgctggctccctttccctccatttctccctgggggtcccagcaacctggccatccctgacttccaacagcacagcgtccccacaggtcctgcagtgctctgcaggggtgcagggagctcccctccccccagccgcaacctcaccttcctcacccccacccctccggcaggaaaccacaggctgggttggggacccctggtgctccaagagagcagtgagtgctgggagccgctaaccccgaggcgcctagcacagactcttctcaccccttatttctgaaataaagcccttccttaggtccagatgaggaccacgtgctcagtgcctcactttcgtgggagtgtatatcactttacagtatcaagacaattttctttcgttacaaatctttatttagtctctgcgtttagaccaaagtagatttttatgggctgagtgaaaaaacctcgcccgcattggtttctgatggaacagctggcagcgccacggccccgggtggggtggcctagaggcaggggtgcttgggaggaacatctagcacccgaccacctccaccaggtgggaaagggacgtttgcaccaaatctccgccggcaaagcagaggctttggggaattacagaaaaactataatgatctaaaagagaacaagttatcttgaactgtgcgggtatttgaatcatacagaaaattgtcctgtgtgcccaatgcacttttgcatgtagagccagggccttcgaggaagctttcaggagatcccgggcagcggagtctggtctggagtttcatttccgtaggtgcagatttctccccaagtcttcccgccatgggctttgcaagaagccagggcccagaggccacgctcaccgttaacactgcacagggcaaaggtggctccaggacaactgcccaaccccaggaacgacccagcagcagagaaaaggacagctgccagggtgcctttgtcgctttttggaaatcagaattcctgggtccttagttaagtcttacttcaccaaatcccaggaccttcacattttggttcttgccattgctaacagttgtaaatgctgccgccacgaggcctgggaggaaggacccgctggtgagagcacagggagtgctgctgtgatcacggtggtgatgcggggtgagcgcgatttcccgggattaaaaagccaccgctgcccccgtggtggaggctgggggcccccgaataatgagctgtgattgtattcccgggatcgtgtatgtggaaattagccacctcctcagccaggataagcccctaattccttgagcccaggaggagaaattaaaggtcatccctttttaaattgaggaatagtggttttttttaacttttttttttttaggtttttagttgccgaatagggaagggtttgcgaagccgctgccctgggccgaggtgcattttacgcttccagaggtcgaggcctccagagaccgcgatgcccagggcgttcccggggaggctgagagacccagggtgctctgggtgactgcacggcgactcctcgggaacccactcgtggctgcccgcttggaagggctttgcggccccgggaacgatctccaggatctccacggctggtcaggttccccgtccctcgtatcccgcgctgcccgggggctcctgcctttggttcagtgctcgcggcaccaccgcactcaggacggcagtggggggctggggctggggctgggcctggcccagcgtgggttggggcgggggacgcgccagcagcgcccgcagctcgctccgcaggggtcgcagccaggggtcgggagctaggctcgtgggccgggagacgccgggcgcgttgtcctccggggaggttggggtgcaggcggtgcaccgaccctcgccatctggcgctgcagccaccagccacggcgcttagtggagggtctgcggccaggctcccggcggaaagattccggggagggctcgggggttgtcccagcccgcgctaagcgccgcagcctcgcccggctttcctgcttcctcggactgtgcaggggaagcctggggtctcgcggggcgcagcagtcaggtcgagggtgcagcaggaggggagtcctgacgggcaggtccctctttcccctggtgcgcaacactggttggtagcttttgcggaggtggtgaagaagggcaggaggcctgttgagcggaggagtccggggatccctaattatgtgacaggagaccctttccagttcggcctgtggcccatccctctctcaccgccggcagattggagtctgctctcggggagcccccaggtaaacccctcacagggagaaggtttcggattggaaggaggaccgcgctcgtggggcgcctgtgagagctgggaagcccaaggggtagcgtgtagggggttttttatgcgggaggagctgcctcctgggcggcggggactttctgtctcagcctgtctgcctttgggaaaacaaggagttgccggagaagcagggaaagaaaggagggagggaaggagggtccttgggggaatatttgcgggtcaaatcgatatccccgtttggccacgagaatggcgatttcaaagcagattagattactttgtggcatttcaaataaaacggcaatttcagggccatgagcacgtgggcgacccgcgggagctgtgggcctggcaggctcgcacaggcgcccgggctgccggccgctgcggggatttctcccccagccttttctttttaacagagggcaaaggggcgacggcgagagcacagatggcggctgcggagccggggaggcggcggggagacgcgcgggactcgtggggagggctggcagggtgcaggggttccgcgtgacctgcccggctcccaggcatcgggctgggcgctgcagtttaccgatttgctttcgtccctcgtccaggtttaggagacgcgtggggacagccgagccgcgccgggcccctggacggcgtcgccaaggagctgggatcgcacttgctgcaggtagagcggcctcgccgggggaggagcgcagccgccgcaggctcccttcccaccccgccaccccagcctccaggcgtcccttccccaggagcgccaggcagatccagaggctgccgggggctggggatggggtggtccccactgcggagggatggacgcttagcatgtcggatgcggcctgcggccaaccctaccctaaccctacgtctgcccccacaccccgccgaaggccccaggactccccaggccacctgagacctacgccaggggcgcctcccgagcgtggtcaagtgctttccaatctcacttccctcagcaggttccacccagcgcttgctctgtgccaggcgccagggctggagcagcagaaatgattgggctgctctgagctctgaagcattcggccgctgtgtgtgtgcaaggggcgcaaggacggagagacagcatcaataatacaatattaacaggagcacttgtccagagcttactgcaagccacattcagttccggaccttattgacttccccctcccatctagagtggattctggtttttcaatttgttttgttttgttttttgtttgtttgtttgtttttgagacggagtctcactctgtggcccaggctagagtgcaatggcgcgatctcggctcactccaacctccgcctcccgggttcaagcgattctcccgcttcagcctcccgagtagccaggattgcaggcacccgccatcatgcctggctaatttttgtagagacagggtttcacccaggctggtctcgatctcctgacctccgatgatccgcccacctcagccttccaaagtgttgggattacaggcgtgagccaacgcgtcctgccttgattctgtttttaactccattttttagaggaggaaattgaggcacagagaggttaaataacatgtctaaggtcacacagcaaggggtggagcggagttagcccactggcctagctctagagcccacccggataaccagaacttggtgaggcctccgggctcttgcttggtttggagccaggtgcttagcgccccgagcccggggccattcaccctgcaggagctgcacgcgcccctgacctcggcttttccctggcagcagaggggctttgcgggtcggccgggtagccctgagcacagctcgccacttccaggtgggctgttggcgctggctggggacacatcccgatctttcaaatgccctttacagagcctcatcaacgacccgattcattcccccctcctgtcatttgtctctgccatcgaaaaatgcctaccgagagctgctctgcatttccgccctctattttgtgttttactttaaaataataataaaaaaaatgttggctgcaggacgccatgacttaggtcagcgagtcagccgctagctctgcatttccaaaaagcagatcttttcacaactctcttgccccaagtgccctggtgtggtttattttttaaaatgcatgcctgcggaagagaagacccggggaatattcgaaaccccgagcttttacaacataaagcgcatggtgtggccgcggcgagtaatggcgct

SEQ ID NO: 165 - DNA, 1500 bp, Homo sapiens
caaatcacttgaactcaagttcaagaccagcctgggcaacatggtgaaaccacatctctacaaaagtaaagaaaattagccaggcatggtgctgtgtgcctgtagttccagctactcctggggaggtcgaggctgcagtgagccgcaatcacgccacttgtactccagcctgggcgacagagcaagtccccatctcaaaaaaaaaaaaaaaaaaaaaaaaaaaaggctgggtgtggtggtcccagatactcagaggctgaaaagggaggattgcttgagcccaggagttcaaggctgcagtgagctgcgatcacatcaatgcactccatccagcctgagcaatggagtgagaccctgactatatttaaaaaaaaaaaaaataggaagaaacaactcaaccacagggctagtatgttactcggttataaaatgataaagccctaaacagagaattagcccgtttccagaagaggccaagaacagatgatacagctgaactgaactcctgcctgtacagctcgttttctacaagattccagacctggaagatgatggcatccagcccccattgaagcacctcgaacaagaaaaacgccgagtccgaagagccaggccttgaacacacgattcctgtctataaataactccccctggggaataaaaagcaggatccaaggcaggaaacccgagccgtggaatctggtaagttcttaggaaacccactcacgggcctgagtcccccgtggaagcggcgacttcggcacctggacacccgagtccccagagccccgggcggccgcgcgtccctacctgcaggcctgataccggccgcggagcgctcctggccccgctcccgccaggctccgggaccgctgaaacgcacccaggggggtgaaggcgtagtcgccaaggacagcgcagatggcagcggaggcatgggagccggaacctaccgtggcaaagggccaggtcgggacgcccctcggcgcagccccaaatcctgcccgcgccccagccccgctcaggccgcgcccctgccacctctggccacacgggctgagacgtctggctcctgcacagcgcacttcccgctgcccttctccactggctgctcaggccctgcctcgccagcacggcatccgcgggggatccctacctgtcctttagggcttgcctcataggtcaaacgtcacctcccagggaggtatggcctgccccctggccaggtgggccccttccacgctcgcctgcaacaccacccacccaccttgataactgcttgtaaaggttgtactgctttcccccttgagactgcaaaccttcaagggcaggaaatgggtctgttttcctggcaaaataatgaagttggcttaaggttttgctgaataaaatgagtgacagacaaaagtagccaaatttggcactcctgatgggttatttgatgaaggaggtgcaatgtatgggcttaactagttattctggatttctttccccatgtta

SEQ ID NO: 166 - DNA, 200 bp, Homo sapiens
caaggccggtgcacgcggacccgaggattcggtagatgtccccgaagacccgctgccgctctaaggcggtggaagcgagattctccggaaacccagggaatccgatgctcgcacaggaccaaagcccgaggccgcggggaccacagagggacggagaagccgggactcctcacatcccacatccggcaggggaagcccag

SEQ ID NO: 167 - DNA, 2000 bp, Homo sapiens
ctgataataaagttttaccattttataatttaaaaatgtaaatatggagttgggcatggtggttgggaggctgagaccagaagatcgcttgagcccaggggtttgagaccagcctgggcaacatgcagaaaccctgtctctacaaataaaaaattagccaagcgtggtagcacgcacctgtaatcccagctactcgggaggctgaggcaggagaatcgcttgagcctgggaggtggaggctgcagtgagctgagactgtaccactgcactccagcctgggtgacagagtgaggctctgtctcaaaaaaacaaaacacaaaaaaacaaacaaaaaaaagcaaatatatgtaaaaataggaagtgcggtttcccaaaatgaggtctgtaaacaactgatctagaaaatgttctggaaaaagtaaaaaaggatcaggatctgaggtcaactgacctctccctgcgctctggacaggcaaacaggcaaggttccctctgaggccgtagcggcttctcgtgggcgagtccctgttcgcaggtgacgtgtggaccacgctcttccgaagcgtctggcctgtgtgctctcggggaggggacgcaggtcagcccacctagccgatggctaacaagtcagtttgttttctgaacggaagcttaaacctagaaaagtaactgggttggggtgggggtgtagccacatgcagtaaaagcactgcctgtctgtataacaacgacctgatgaaaaaaggaacgcgtgaaatggggagtgttagggcgtcacaaactccagtgtggttgaaatgaaagcagaaagcaaatggcaagctggcttccccttccagcttttcacaaccctgccttgctcatggtcagccccaagcacgggcggaagaaaggactggaggggagggaaaggggtggggagcgagggtaccagaggcgtgggaggacggggacaaaggggcagcaagggaccggcggaaaggaaagtcggcgttagctggattggaaacagtccagacagaacgatgggctctgctgcctccgggtggggcaccaagcggggagcggggccacgaggcaggggacagtgaagcaccatgcagcgcccaccagccggcagcgcccaccagcctgcgctgcgctgcacatggtacccgcggccccagctggccagtgtgtggcggagatgagaccctcgtgaagagactaagcggccacagcagggggaagggttgctcacataaccccatactgctcacactacgaggttaactgccgtgagatctgcctgcagccagcagaaacccgttctaggaaaacgttgcccagtgacttcagtgagtgccactgacccgggcgcctccgccccggcgtccggcagcagcaccgattgcgcaggaggcaccttgcaaacaacctttcctgatccgcgctgcagttcccaggccggttgcagccgtttcacagagactgcgcacacaaagcgtctccgtgccctgccattcacctttcgacacagccgcaacccctcttttcagtgttaaaacctggcgccaaaaggaacatgcgatgtgacgtgttacctctgcgcatgcgccgggcattcccagcgccccgaacctgatgaacgcgcggtggggaccccaggcttccgtgctttcgttttcctggaagctacgtgtcctcagtctacatattgttacctggaaaataaagttttctccttttttcttcctttgttaacaggcagaaggtgtaggctgcaggtttcgggcctaagagagggcatggctggcgacacggagtagactcctagatgacataacggaggcgagtctgcaccggggactcggcattaggaggaggcagaggaaaagcccaccaccgtggccgagggagatctagcaagcagcttgcagggggtgaagtgtgtgcaaagcaggctgagacctgtccagtatcgaaacacgccgcggtggtcaagcaggctttaccatgct

SEQ ID NO: 168 - DNA, 700 bp, Homo sapiens
tgaggctcaaaacaggtgtctgtgagcttcacaggcggtaaggccgtgtctacatggccgggacatgcatcccggggctgcccctgccgtgctgcccgagtgcacgggggatgaggacctgacaaggccattgatcttgcgggagcttcctgaactactccagcgtgaaaatcttccagaaggattctccacagggcaatgaggcaagaaatttacagcttagcctgattaatgggccaggcagttaagagttctttgccaagctatgagcataatttatagtcatcacggcaggaggaaaggccacataactcacatccttaaagggcccttagaacaagagacacgccggatcattgaaaacgtctccactcctggcgccaaaagagatcggcacgtttctgggtattctggtcaaagaacagggagtctggattaatatacacggcagaaaaaagcgaagaaaagacacacaggtcatatatttctgactgatattccgtttgttgttttcggagggacttggtatttatttaaccacattctcacttgacacgccccctccccacaccttgtaaatgccttcctctttagccgagtcatttttcatcacatagaattgaaatgttgccaggaaggcggtttatgagattgtagaaatggcactagagaaagcagtgtgaaaagaggcctagaacgt

SEQ ID NO: 169 - DNA, 600 bp, Homo sapiens
tctctacatgctatctactaaaaacttaggcaaggaaatgcatcagaccaaacaccccacagcacagagaaccgaccggccattgctttccaatctccgcaaacctaaccattgctggaagaaatcttactcacagtgcacagacagtaggtattttattgaagataaacatatagtggaacaaaccaaattacccccatttgagttacgtgagcactcagttctcagcgtggatgtcccacaaatcaagtcaacatttgcgtcccattaccagcagccacttgccgagtatctcttcgcttccactgggactgcctggcatccctgatgctaaggagccactgaagagcctccaaatgtctgacattcacaaacgcatcttttgctttgacccgacccttcaacctctccgagtctgctgccttttctcagacacacatccaggcaccgttagggatagttagagaatctgaaaattcagaagcgctccgaaaagcctttccaaaagtaatccacagcactcaacagtgaatttagaaaccccaatttttttctgagtttgaagtttttaagccttgcggatggttggagtaggaaaaa

SEQ ID NO: 170 - DNA, 1100 bp, Homo sapiens
tcagacaagctctgtgcagtcggaattttttaaagatgcactgtcacttgaggaagacaggtgatcttcctgcggcacaaatagaagcaaagagatttctcttcttctctgtagagcaacacaattgataaatggccgataatctccaccaaattggcagcagtaggctgcccgaaggcagcaggcatattcgtctttgtgaattgttttactatgatgctgtcacatttccaggaataagacggttaaaatgatatattgttgtggtttggcatttgcagctttgctctgacttccctggtaactgccaacatctgcaaattattatgtgcttaaaaaaaaaatcaaccgccaccgcaggctgcccccacggtccctggctgggccaggcctcctgccaggccacagggcagagttcttggaccaggaggcagcagggtcaaaacccaggttgcctaggaagcccccaaagacagttatggatagagctgggagcccgaaacacatgcggcagtctctcagtttccaggtaccggttctcacatcatccatgcatgtgtttgaggaaaaacaaaaaaaaattgatggttgccaaaaacaaaaatgcttccatatcaaagtttatcagtgtcaatgtcaagagacttctggttcgtagactcattttggcttgaggccaccagaagtgaactctggtttctaaatgcagaagcagaggcactggccgatcatggaagatgcagggaactgttcaagaggcccaagcctggtgctcagaaacttggcaggatcaagcatctcgcccaggaattcatcccctgcttgtctaagccggctggctctcgtgactgactcggaacaacagagcagatgtttgcgtgggaggcaagcctcacccaacatctgtcctgcggcgggaaggcctgggtgttcacagatagagctggagttccccggtgggtggcacagacaattagctggggctgcctcacatgtaatctaattacaggggaaacaggctcaaacaccgggtgataagcagcgcaactgtttcgggtgactctgtaatttttcctccattaattttctccataacgcac

SEQ ID NO: 171 - DNA, 250 bp, Homo sapiens
gttgcctgggatatgcttatatcaaaaacttacgtgtcacttacctagcatttgcatttcactgggcctcctaaattctgtgtggtaaccgactgccaccggacatgctgtttacttctctatcctcacgcagccagttgccacattcaacataacactgcaaatattgccggtggatcctgacttcctcgtggaccctactgtgtcgggaaaaacaaacaaacgaaccctggaaggaaacaccatgagt

SEQ ID NO: 172 - DNA, 600 bp, Homo sapiens
tcataaatatttccaaatgtattcctatttgtctctacagagtctaacagacataaatagcgaattgaaggttctgtcttaaaacccagcagaaagaaaaacaatgaccagaaaaaaaaaacaattgtctttggcttcccaagaacagcatcggatttcaactggaaccacagatggtccgttgatagaagcgactactttttagctctggaggacgacaaaaggaaccagcttcttcctgtgggtgtcacagcgaggtcgcctggccacatcaggtaccagagcgagcgccctcacctgataggccctgtacaacctcagccacagcactgtcaggaggaacacgcggaactagcaacctaggagggtaaaggcggagttgggagggaacacgaggcaggcaggtcggctggctgctgagctacaggctgcactcctaggacgtctacgtgtaattgagaaaaataagacaaaaataacttactgtgcaggcaattaattctggttggcatagcgatcctcttaagttaaagggaatgagcatgagatgaagagaagtaagaggcagaaagaattatgcaagagcaacatcagagtgga

SEQ ID NO: 173 - DNA, 2000 bp, Homo sapiens
acgccgagccgcctctgcaggggaaaccgaagcagatgtggtgagataatacatccaaccctgagtgctactctaacctgccagaggcggagggttctcagtgagatgaaagcattacagatgcgttagatctaagggaggggcctgcagatgcgcagctggcagagaaaccagggaggggctgaactgtcagtcgcgaccaccagggatctgaatcagttcaccgacagccttggggacattcaccttgggctccacaacctgtcagaaatgcccccaagcccaaaggcgtcgagagaatggccaggttgtttcagattgacacatatcctaatgtacaagtcagcccacacaccccacgtgcactgagcgtctcttgttgttcaccccaaataaactctgccggaactggggcgggactcgcaggggcggagaaggggggagacgggcagagggcagaagtggatggtgagaagagccaatggaggggccccgtgagagtgagcaaggctgcacccctaaccgacgtcctggggctactgtacaaacaaagaaccacaggctgggaggctgaacaacagacctgcactctctcgcagctcggaggctgcaggtctgaaatcgaggggctgacagcgctggtttcctctggaggctgcgagggagaaaccgtcccctgcctctcccaggctctggggtgagcccttcctggcatcccgggctcattgtagatggatcactccaatctccatggcttctcagggcttccctccatgcacctcaaatctctctctccttccttttgtaaggatgccagtcattggatttaggttcaccttaaatccaggatgatctcatctaaattacatctgcaaaaagaccctttttccaagtaagttgacattcacaggtacctggggttaggattggacatatcttttgcaggggtgcagggggctgccactgagcccgctgcacagggtgacctgggccaagggcccttcactttcacttcctcattggcaagctgccctgtgtttggactgggtcgaggctgtcaaccttgctgcccctcggagtcccccctggtgtcccccaaacagattctaagctgctttcctggggctggaggccaggcattgggattttttaaagagcttcccagcaggtgagcagcctttcatgggtatcaggagaccttcctggcaaatgtggtgaaggtccttcctcctgagcgatgccttagacccaggagcccagggaggctgctcacctgatcgttaggacaggagcagtggaaacctctggcctcagaccccctggaggaatccctccctctaagactctgggactggtgcacgcaaggagctatcgtgaacattgctcccaactggccgcttgcttgtcccccggctccccttggccccagtggcggctttgcctgaattagagggcgtgagagccacctgtgtctcagcactgcaattaaagcaggaagccctttcggaagcagccgtgtgcaccagcctcccatgggtggagcagagcaaaccacccacttctgccctctgcccttcttcccttttctcgacaccctgcggccccccagtttcagcagagtttatttggggtgaaaaacaagagatgctcagcgcctgtgggatgtgtgggctgactcgtacattaggatgtgtgtcaatctgaaataacctggccgttatatggatgccttggggcttggggggtttctggcagtctgtcgagcccgaggtgaatgtccccaaggctgctggtgaatcagatccctggcgttctccgttggcagttcagcccaacagtttctctgccggccgtgcctctgcaggtccctcctctgatctgattggattaatatttgaatcaatagactgagtcaagcagaatgtgggtgggcctcatgcaatcagctgaagccctgaaaagagcaaaagggctgccccttcccccgaggaggagagaac

SEQ ID NO: 174 - DNA, 200 bp, Homo sapiens
gaatgttcaaagaaagagccctccttgccttcctcttcttccacccctgccctctgcagactggggttctgtagacccccaaagtaagtccgccacaccggaaggaagtgagttacacaggggcccacatgggaaccgctttttgtcctgtcttggtgggaaaatggccacgaccccagcccaggctctgccacgccaca

SEQ ID NO: 175 - DNA, 400 bp, Homo sapiens
aggcagcagggttaggacttcaacatacaacttttggggggagatgtacttcagcccataacacaccacgtgggaggataacaccgatttcagagcttgcagaggaagccgccaggaactccagtgagacatcagcccccaggtgcctgtcaggcacgccgggctgtggggggcacctgggcccatctgagtaacggaggcgcatccgcacttcccccaggagtacatttttagaacccacagcgccataaaccaaagacaaggagacttcctggtgccccgtcagcttctggaggcgacgttctcggctgacagctctggcagcctcccctgtaggtgagagacaggtaaatgggactcttgcttccaaaacggaacagggtaaaaattctcaagcgtt

SEQ ID NO: 176 - DNA, 300 bp, Homo sapiens
ttaaaggggagtggttgtatgaagagttcctcagtcaaaggtgtgcagctgggaagcccaccccacctaagagggaggtctgacaaactgtccacactgaaccactcagacctgcatcagggccccgtttcttccataagccgccaagtacagccctgagtcaactgaactcaggcctgggaggcttcccaaagctgacttgactcagctttgaactgaaatgaccgtaccatgacaaccctgatgaaaagctaaactgagcccaattattcaacagtaaaattcagttggtctcactca

SEQ ID NO: 177 - DNA, 450 bp, Homo sapiens
tgctaccagctgcttgggcttgggcaagtcaccctagctctcagatgtcatctgtaaatgatgacaatgccaatgtggcactgttctgagagtcagacagaacgtatgtgtgcttcacatatggtgctcatgaagtgctatcattatctaaggaaaacagaaaacgaagttcagagtctctctaaacgcatgacaccagaccaacagggagtttcaaaaaataggtctgaagtaaatcaattctcctggtctcaatacactgaaaacaaactattaggggactgaccgaacccaccttaggaaccaccttacgtcaccttctgtctctactgcaaaaccctcccttaatactgttcaaatacgctgacaatccagatccatatccaatggaaccagcaatcatgcctgtgtgccagcaatgtcagggagggaagccgatctctgatgaat

SEQ ID NO: 178 - DNA, 1300 bp, Homo sapiens
caagcctgtggtagggaccaggtcagagtaaacaggaagacagctttcggccaggcggtgcacctcggtgccggtgagtgtgagcgtgtgtgcgtgtgcacgtgtgcagatgtgtgtggacgctcccttctccgcagcagctcctgaccccctgcaggtgaccctcagccagccccagggctgcccccactctcccctgtggacacctacctcatttggggtgaagtggggggactggggtgtgaggggtgctttggggggcacacttcgacccctctctctgcaggccaagtcctgaggctcagtttcctcctctgtgccccggcgacgtggtgcaggcctcgcgagtgacgtgagggttcatgacccaggtgtgggcagccagcccttcacgggaggccacccacctggccacagtgcctgggaatttaggtcgggcactgccgatatgtcgccttccacaaggcgggcccgggcctctgctgaccgtgcaccggtcctggggctgggtaattctgcagcagcagcgcagcccatgccggggaatttgcgggcagaggagacagtgaggcccgcgttctgtgcgggaactcccgagctcacagagcccaagaccacacggctgcatctgcttggctgactgggccaggcccacgcgtagtaacccggacgtctctctctcacagtccccttgcgtctggccagggagctgccaggctgcaccccgcggtggggatcgggagaggggcagtgtcgcccatccccggaaggctgagcctggtgcagccagggagtgagggggcgggaagccggggtgctgccctgagggtgccccgacacgctctcctggggccctgagcggctgccacgtgcgtccagggttctggccacagggtgggcaggggccctgtgctcctcactggaggcccctgaggctctggaactgagaccatccacccgccggccccctctcgccggctccggcacccctgcctactgtgacttcctgccccggactcgctctgccagcttggggcaaaccacttccctctggggttttcacttccctctttcccaagtggggaaagaccacctgtccccgacccagaaagggcccctgcccgagggcagcagcagtgccaggctggcatgtgaggcttggggcaggcccggcccccagaggcacagggcgatgctctgtgggacgctgtgtcgtttctaagtacaaggtcaggagaggagccccctgaccccggaggggaggagaggcagggcaggaaaccgccaccatctcagccca

SEQ ID NO: 179 - DNA, 200 bp, Homo sapiens
gcccactgtgggtgtgcccgtgtgtgtggctgtgaggcgtgagtgcaggcgtgaagtgtctgggagtgggagcgggcatgagtgtgtgccacgggcctgctgttgggtccttggaggccacggttgcccctgaagggactgcaagctcttttttgatttgtagttatttgagaagtctatacaggaagaaaattaaaccg

SEQ ID NO: 180 - DNA, 1000 bp, Homo sapiens
agcgcccagcgcagggccgggacccagagtggactctaccgtggggctgcctcaaagaaatctcagcaaacacaggaagccagcccacccgtgcagccatggggccaggaagcccgccctttaccaagtcatttgggcattttttctctgtgctaacagcccagatggagccatagcctcaacctctgtgttctgataacaccaagctgggacgccggagccatgcaggggacagtgcccggcctgaggctgcagcctgggtctggatgcctttctaattcagggcctcctcatggcctggttccataaatggtcaaatgcagcctgacagcgcagcctcctatcagcgctgggctccgtaccgccacacagcccacataccccgttccccaggagacgcccgcaggtgggcagcgtcactcccacccgccgagcacacgctgtccccgtctcgtgtcccgaggagccggaagcagctgcttcctcccagcctgaaagctgcacctcgggctgcactcggctccccgaacccgccctccgctgccctgcaattcgccaagggagctacccttcccatataaaaatttcacctccatttccttgtagagaagaaacatttctgacagcaaggaagattctaatttgaaaagcaagtgattcatctcccggtgccaaacagcagacgcaggcgttaccagtctgggtggggcgcccgagctggggacctggggtcctctgggaggggcaagaaggcagcgatgctggcccccgcctccatctgcccatcccatctgcttccacacaccgccctgccgtagctgcttgcagcccttctctgtcagtttctccatcttttggtttggtgataaatgagagttcccatcgggtgtgccaccctctgtgtgacggggagcagagaagaccctgcgtccaagtcctcctgggggaagagcgaagatgctgggaccagccccagctgtcagggggtctccaatcccag

SEQ ID NO: 181 - DNA, 300 bp, Homo sapiens
cgcacacacagcacagacgcctgcatcttcccatgcgtggtttctgctcttgcctctctgggtttttgtttcacttcggtcgagtttttggtggtgttgagcggatagccggggaagttggagtcttgtttgtggccgcctcgtgctcgtgtctgtatctaagatcctcaggctgctcctttttgggtaaggtctgttgcttctctaggaacagtgacggtggcagagcccgtggcccctctctcctgtcccagagccaagctgtttcctctccccactcccgggcaccctgcgggcaag

SEQ ID NO: 182 - DNA, 5000 bp, Homo sapiens
aagaggaaattcccacctaataaattttggtcagaccggttgatctcaaaaccctgtctcctgataagatgttatcaatgacaatggtgcccgaaacttcattagcaattttaatttcgccttggagctgtggtcctgtgatctcgccctgcctccactggccttgtgatattctattaccctgttaagtacttgctgtctgtcacccacacctattcgcacactccttccccttttgaaactccctaataaaaacttgctggtttttgcggcttgtggggcatcacagatcctaccaacgtgtgatgtctcccccggacgcccagctttaaaatttctctcttttgtactctgtccctttatttctcaagccagtcgatgcttaggaaaatagaaaagaacctacgtgattatcggggcaggtcccccgataacccccagctgcagatcgaggcctagtgcgagcacaggtccccccagacccttcccagtgcccaccaaccggcggcctaggccaggtagaactggcagcgcctcccctgctgcaacaccaggctctggtagaaacttcagaaaacatgcaccggcaaaaccaaggaagggtggctgcgtcccgggttcttccgcgcagctgtgtgtacacgcatgcacacacccacacgcacacacccacgtgcacacccccatgcacacgcacccacttgcacgcccatgcacgcacacacgcgcgtgcacccatgcgcacgcacccatgcacacacacgcgcgcacacacccacgtgcgcacccacatgtacacacccacgtgcacacacccacgcgtacacacccacgcgcacacaccgctgtccccagccgtgcagaacgatcctccctgagtccccggctccgacccacacgcagcactcgctaaacgcttcccacgcagtcgttttgctgggttgcgcttcacccacttctcagagggggcggccgaggcagaggtgtcggggatcgagcagctccgggcctcaggggtcgccccgccaccgttttcctttcccagatgctgggacgggggcagggaggggctccccaggctgaacccgactaggtcaccctagaagcgaggcgagcttctcttctgtttttcttcggcgcccctgagcccctgacagtgcccaagctgcccatgggattggattcgccagagcctcctacgcagaccccacccagggccaaagccaaccccaagccccaccaccttggtggtgtgggatgaaaagtgagccatcgagagatggggtccccccacccccaacccctccaaggacaaaggcgggctgggaagcacccgctttcacgtccgcccctgcccggctttcctagcggaattggcgccggcatcagttgggggttgtgggatcagtgaggaatcccgtggggtcgcctccatttatcagttgtgtggggttgggcgagcacccctagccccagcccaggcgatcagggcgcgaagcccactggacgcggatttgggattaggacgggggtgacagccaggaggaccgcacctgccctccccactcctgccgctccacccctgcccccaccgcaacaccaaggtctccaccaggaagatgggggtggggaaaggacgcggggtgggggggggtgcggggagagaggacacagggtcggaagggtgaggggtagtggcagaggcggaggccgaggccacgcagctgcggggcgcagggaggggcagaggaggggcgttcagatgggaacctagtccagacccgtcggggccctcgtgtgcggctcgttatcctggaaccagagaggctggagacccttggcttgtctggagcggaaccgtagtgtccaatagagtgtgtggggctcagccctaaagctaaacattctttatttcctgatgaccatgggggcggagcgggggaaaagccctggccttatagtttagaattttataaaaggaaaggcgtggccactgacaatttgcgcttcaggagtcccagagtgaccgcctggctcggagcagggaatgagggggtccttaactctgagatttgttttctgagagacaaaggtgatgggtgaggcggctaagcctctgattctctataggtggcggtcattcatttcagaacatgaatggattcagtaaataaacatgatagaaaaatgccacaagccctaggcccattggagtggactggacagtctgttcccagtgtgtccctcagcctcggtcccccacccttcccggagccctgggggtcacacacatccctcctggctgcctagcctgtgccccccgattccccccctccccgccccgcgcgtgcacacacacacacacacacacacacacacacacacacaccacacagcacgaggcgacagagatatgagagagagcgagcgagagaggacgggagagagagggagtgcaagtgtgcgctgggggtaacccgtgcatgcatgcattgggggtaacaggctggagctcagatccctcccccagcccccagcaggggggactgcaggctcctggtctgagtggggagctgggccccctggacagaggactgggctgcggggtcaggaatgggcacacttcctaactgcaggacactctaagggctttggtcatgcacacgcagccaagagaaggtgtcgctggcacacagccttccaggagcggacttggagacctcgccaaggaccaggactccccagcactcacactcccttaggcgctgaagtccagaggacagaggttgagggcagagctcctgggagcaccagtggaagtaggagggctgggctggaaaacctcccccaacctcctattgcaaagaggctccagccagcagcctccacaccccagtgatcttttaagatgcaaatctgcgccatcatttatttcctcagtgccttctccagctcctgggatgcacactgcccgtccccaggcccagagacctgaccaccctcattcctccctcagcccaccctggggtctctccaccagctgacagccttcctgcagtcccctccccgaatgctgctccctgaggccctcctggacacctgcagggcaggcacagcccgcgggacctcacagcacttgctccgggcagagctgcagtttggccaagttgccagctccgtgtgggcaggggccctggcctgtggctgccacatcccgggtgggggcacggcctttcctggcgtggatgctgagcaaacgtagggggaaggggagtgaatgaggagagccaggtagctcaggggctgaggcctcactgagcagggtcccgcgtgaccggtccccaccgctgacggttcctggggtaacactcaggacagggagaggcaatggaaagagacgtggccgccctcgcatcctgcagctcccgcactcccagcctcccagcctcccacccagccccccagagcccaccagtgaccccgcccactgggtcctcagatggctcccacgggatctcctgccttgatctcctgtccacatggaggtgaagtgggttgctctgaatgaggggtgccgagcctagggcgcagcccactctcctgggtccgcagcatcacgcagcccggaccacaggctccttacaagaatcggaagggtccctgcaatcgcccttcgcactgaggcttcctactgtgtggtgtaaaaacacaggcttgtcctcccttgctgcccacggggctggagccgcctgaaaatcccagcccacaacttccccaaagcctggcagtcacttgaatagccaaatgagtcctagaaagcgagagacgagaggggaatgagcgccgaaaatcaaagcaggttcccctcctgacaactccagagaaggcgcatgggccccgtggcagacccgaacccccagcctcgcgaccgcctgtgacctgcgggtcaaccacccgccgcggctccacgccgtgggcacagactcagggagcaggatgagaaagctgagacggcgcagccacggcccggtgccttcacgcgcacagcgacacagccccagccagcggggcccacgctaaggcggaatcccacagaagcctacagagcgagcgcgcgcctgtgcttcccaaaacggaatggaaccaaggtgacttctacagaacgatctgaagccctggctggcccttatgctagtctcttgggagcgttccaaatgcagctcaatattacttacttgacttttatctttcctccctggttcgtggtatttataactgggtcatcttttaactatttgcaacgtagcttcaggggagagggggagggctttataaataacctgtattattattatgcaggttgattctgttccctgagctaaagggaacatgaaaatacatgtctgtgactcatgcccccccacccccactccagggtgtgctgaggagtctctcagctgccccggggtcctcgagcaggggagggagaaaggctggcgctgcgccctccatcgcgtgaagccaggggattttgctctgcgacaagctgacttggctctcgtattgtttgcagaatcacccagttccaaggcagtccctgcgggcaggtgcagctgtgcgggagcttcagtcctgtccccaacacccaggcagtaatggttccagcacggaaggtctacctacctcccactgcacagcccgagggctgtcctggaggcacagccatccgtccctgggtgggcaggcacgtttatgacccccacccccacccccaccccccacgcgagtcagcacgttccatactcgggtgatcgtgctcatcccctggtcatgtcatcgggatctgagtgccatccgagcagagagctgtggcccggtgccgggggtggacttcatctattccagggaaccaaggatgcatgatttgcaaacaaaaccagaagcgcaagccatctcctcgcctcccctgatagccgtgctgcggagcctgagtgctggag

SEQ ID NO: 183 - DNA, 400 bp, Homo sapiens
tgcgtttagtgtaaaaatatcaggtgtggctgcacggagtgaaaaatcacaggctccacggagccgggaggcctgctgccctgccctcttgctttgatgaggaaatggcgaccgcagaaggaaatgtagcagcaccggcaaccggcatccgtggggccacgccgggctgcttcccagggccctccagccaagcagccacaggaaagagtagatgttgatcccaagctaggactgaggagtccgtccctaagagccgagggagtcaggtgggcgaaactggccgcatgtctgggtacaactgctcagggtttctcatctgctgaatcaccaagctaggttctgaagccaggcgtgagtgagcaggactggagcaggattctgggaacaatcttttccctcc

SEQ ID NO: 184 - DNA, 293 bp, Homo sapiens
aggtggaggttgcagtgagccctcctcccctcctcccccttcccttcccacctcccatgcccccctttcttcctcccactcccctcccgaggccccgcttattctcccggcctgtggcggttcgtgcactcgctgagctcaggttctggtgaaggtgcccggagccgggtcccgccttcggcctgagctagagccgcgcgggcggccggcttcccccaaaccctgtgggaggggcatcccgaggaggcgaccccagagagtggggcgcggacaccttccctggggagggccag

SEQ ID NO: 185 - DNA, 474 bp, Homo sapiens
ccttccagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgtacgaggggaacctcctcttatttccttcacgttgcatcgggtatttttcgttattgtaaataaaacggttccgagccgtggcatcgagagggcgtctggagttcagggaacgcgtggcccccgcccgggagcaccgcgcagcgctcgcctctcgcccttcaagggggtccctgcccggagcctgcgcccccggagaggaaggggctcgaggggcttgggtgccgcagcgcgtccttccgtagaaaaggcttgcgtcagtatttcctgcttttacctcctgag

SEQ ID NO: 186 - DNA, 346 bp, Homo sapiens
cagtatttcctgcttttacctcctgagtattggaatattcgagtaaaccctggagtttcagcgccagcgcacgcctcttcatcagggcagcgcgtcgcgagcgcgctggttccccggggcctcccggccacggacaccgctctagccagggccacggcgaggccgccgagcagcacctcagagacctgcgtgagttctaaagcctggggctactacaattctgctcatctgtttgtcctgtgaaatgattcagggacatgaaaatgccttcccactgacttgcgtcctgtcttagcctggacttgtccccttgggaacacgggccaggcccctctgttcctgaagt

SEQ ID NO: 187 - DNA, 2000 bp, Homo sapiens
catacatggttattagaaaaggcatctcatccaaatgtggtggctcgtgcttgtaatcccagtgcttcaggaggccaagggaggaggattacttgagcctaagagtttgagaccagcctgggcaacacaacaagaccttgcctctacaaaaaacttaaaaactagctgggtatgatggtgcacacctgtagtcccagctacttgggaggcggaggcgggcagatcgcctgaggtcaggagttcgagaccagcctggccaacatgatgaaaccccgtctctactaaaaatacaaaaattagccgagtgtggtggtgcatgcctgtaatcccagctactcaggaggctgaggcaggagaatcacttgaacccgggaggcggaggttgccatgagccgagatcacgtcactgcactccagcctgggtgacagagcacaaaagacaggcatgactttgtacttaactgctcagctttgtaatcactgggggcccagatgctcacttggattctaactttgttggcatctgggcctaaaagccgtgatgcaggtgagcaatgatgcagagggctctgtgcgcctggcgggctctgtttgcctgctgggctctgtgcgcctgctgggctctgtgcgcccgggaaggtgcggccaccctcacgcggaaggcggccagcggatcccggtgcgcgcagctcccagcgctggggttccagcgccccgcctcttcctatagcaaccagcgggacctgccgtcccccggggcaccccgaggggtctgcgcccgcttctttccgaaacgggaaggcgctgggggctcggcagccagagggacgggttcagggagcgtccggtgagcctaagacgcgcctttgccggggttgccgggtgtctgcctctcacttaggtattaggaaccgtggcacaaatctgtaggttttcctctgggggtgggcggaggctccaaaccggacggttttctcctggaggactgtgttcagacagatactggtttccttatccgcaggtgtgcgcggcgctcgcaagtggtcagcataacgccgggcgaattcggaaagcccgtgcgtccgtggacgacccacttggaaggagttgggagaagtccttgttcccacgcgcggacgcttccctccgtgtgtccttcgagccacaaaaagcccagaccctaacccgctcctttctcccgccgcgtccatgcagaactccgccgttcctgggaggggaagcccgcgaggcgtcgggagaggcacgtcctccgtgagcaaagagctcctccgagcgcgcggcggggacgctgggccgacaggggaccgcgggggcagggcggagaggacccgccctcgagtcggcccagccctaacactcaggaccgcctccagccggaggtctgcgcccttctgaggaccctgcctgggggagcttattgcggttcttttgcaaatacccgctgcgcttggacggaggaagcgcccacgcgtcgaccccggaaacgaaggcctccctgatgggaacgcatgcgtccaggagcctttatttactcttaattctgcccgatgcttgtacgtgtgtgaaatgcttcagatgcttttgggagcgaggtgttacataaatcatggaaatgcctcctggtctcaccacacccagggtgacagctgagatgcggcttctccagggtggagcctcctcgttttccagagctgcttgttgaagtcttcccagggcccctgacttgcactggaaactgctcaccttggcatcgggatgtggagcaagaaatgcttttgttttcattcatcctagtgttcataaaatggaaaacaaataaggacatacaaaaacattaataaaataaattaatggaactagatttttcagaaagcacaacaaacacaaaatccaagtattgccatgtcagcaacacattcctactttaagttttatgaagttaattggagtagtggagaacaaaagtggatgtggggcag

SEQ ID NO: 188 - DNA, 149 bp, Homo sapiens
gctggaccagaaagtgttgagtacctgctcatgcgtgcaagaggaggagggaggagcacatcactgaacttcacatgaaattggatacccgggattagagacagtagagggttttggtgaaatcagatacacattgcaaagcagcacac

SEQ ID NO: 189 - DNA, 146 bp, Homo sapiens
ggtcgagtttttggtggtgttgagcggatagccggggaagttggagtcttgtttgtggccgcctcgtgctcgtgtctgtatctaagatcctcaggctgctcctttttgggtaaggtctgttgcttctctaggaacagtgacggtgg

SEQ ID NO: 190 - DNA, 133 bp, Homo sapiens
cctcgtgctcgtgtctgtatctaagatcctcaggctgctcctttttgggtaaggtctgttgcttctctaggaacagtgacggtggcagagcccgtggcccctctctcctgtcccagagccaagctgtttcctc

SEQ ID NO: 191 - DNA, 95 bp, Homo sapiens
ctgttgcatgagagcagaggggagatagagagagcttaattataggtacccgcgtgcagctaaaaggagggccagagatagtagcgagggggacg

SEQ ID NO: 192 - DNA, 127 bp, Homo sapiens
tgcaggatatttggcaaggtttcttactgttccaagttttttttccgaaaacctcccttgaaacttttgtgcttacttgtggtaacatacccataatataccctcttaaccatttctaccggcacag

SEQ ID NO: 193 - DNA, 104 bp, Homo sapiens
tgaatcagttcaccgacagccttggggacattcaccttgggctccacaacctgtcagaaatgcccccaagcccaaaggcgtcgagagaatggccaggttgtttc

SEQ ID NO: 194 - DNA, 127 bp, Homo sapiens
ccgttatatggatgccttggggcttggggggtttctggcagtctgtcgagcccgaggtgaatgtccccaaggctgctggtgaatcagatccctggcgttctccgttggcagttcagcccaacagttt

SEQ ID NO: 195 - DNA, 144 bp, Homo sapiens
ccaggcaagatggcttatgtctttaatctcagctgtttgggaagccaagtggaaagattgcttgaggccaggagttcaagaccaacctggataatgtaagaagacctcgtctctataaaaaattaaaaattggctgagcatggt

SEQ ID NO: 196 - DNA, 110 bp, Homo sapiens
gacccagacgatacctggaaattatttgctcatgtggcagtcactgttgattgcctacccaaagccattactccttctccccacctaacagaagccgagttttgttcagc

SEQ ID NO: 197 - DNA, 101 bp, Homo sapiens
ccacatcctggccatctacttcctcttaaacaagaaactggagcgctatttgtcaggggtaagtgcgaccctagaggcgatcgtctctgctgtctgtggaa

SEQ ID NO: 198 - DNA, 88 bp, Homo sapiens
tgagctcacaggtctggaaatggtctgaatagaaaggattggtctccggaggaaagcatactcttcctattaccagaaccctgtgggg

SEQ ID NO: 199 - DNA, 128 bp, Homo sapiens
attctccacagggcaatgaggcaagaaatttacagcttagcctgattaatgggccaggcagttaagagttctttgccaagctatgagcataatttatagtcatcacggcaggaggaaaggccacataa

SEQ ID NO: 200 - DNA, 836115 bp, Homo sapiens
  NC_000021.9_gene_539 [gene=DSCAM] , region 40010999..40847113
tgactgaggccggagcacggcaaagatgagcctgcccgcccgcctgctgcctggatgcggagggtgagggctggcgcacgggaggccgctggctgcgcattctgggcgccgagtgcccgggatgagctcacgcccgcgtctgcggctctctccacctgccgacctgccgggggcccactgagctgacggcgcacctgggctccggccgcagcgtggggcgcggcgcccgggagcaggtgtgcaggagcgcagcgcgcggcgagcgcagccctcgctccggagcccggccgcgccgcgtgcccgggcggctaggcagcggcggcggcggcggcgggcggcgggcgggcggcggcccccgggcaggtgccgagcggcgagcggagccgggccgggcggagcgcggggggcgaggccggcgcgtcgctcgcgggaggccggggagcggcaggggcatgtggatactggctctctccttgttccagagcttcgcgaatggtgagcctttcggtttgtgatgaatttcgtttccttatcattgaccgggggggcgggggggtggggggtggcattggatgcatgggtaaagtcttctttctttttccgcttcatctgtgtttaaaatttcgtgcttttatttattttttaaatatcatatttattttttgggggagaagaggtggcaatggagaggcccgggagaaattgctctgtaatcattggaaggcgcttacctagccaagtgacagctcagagcctaactccagtactagagagctgcctcattcagaataaaccaggtttggtgacagaaggagagacaggaagattgccactttgaatattacaacctggaaagggatgtgacattccaagtgcacgcaagtggaggggtcaatgaggaacatctcccttcagattcaatgctttttgagatttttcaaacacgtaatttcatgctagtacaatgtatctccagcaccaaggagggctttaagaatgttctgtccttctatgcaccccgtgctgcttcatgctcctcacagtcgtttatgtaaaaatatgcactgataagcattacatcatctgaaatgttgacaaattaaaaaaaaaaaaacacctgtatagttgtaaaaatgaaatcagtgaatattgtaaatagcatacatttcctcatgcccagccaatattatattttgaaatgatttcttcctgggtatttagaaagctattgctcttgactgagtcagacccaattagtaagtgtgactgcaccttaggctgcctgtcaccgcataaatatgaacttacatgtatgaatggcttcctctcttgtgggaaccagaggaaattgtcatcatttgacatcgcctgggagtagctacggcttaaattcccatttcaaattttggaacacacatctgcataaaatgtataacctactgacagttgaaattaaaccattaagcagaatcccctagccagaagagaggagagagagagagagaaagagaggagggagagagagcgagacagacacagagacagagagagagagagagagagagagagagaggagaagaagagaaggtaaaagaagagaagagaggaaatctggcccttgtgagaaaatacgagaagcaaaggggaggctctaagattttcctggaagacacacagggaagctctgtgtgttggctgcaaggcagtgcattttctttgcctacctagacagtgcctaaagaatcagcataccaacaggccagaagaaatgcatgagcattgtcaattttttaaaaaaacggtgactaagaaaaggtagagttgaaagaaggtactatcaaaatgaacatgaaaatgatactttgctctccagtataacctaaagcaaagtgtttgaaactttcattttgagatttcctagcaggaaagaattgcaacaagttctgacaagacacccatctttcccagagggcaccatacctgtcctgtgtcctcctgggaatttcccttcagggacagatgtgcttagggaacatgcggagatgtgtcggggaagtcagccctttctgctcttctgctaatgcgacctcctaagaaatgtagagatgcctacacatgtgttccaaagacacagagccttgacaccctgtttcgcctgtcagggagtacctttctgaactccttggaaaggcctgggttataagaagaaacaaaatttgcaccccattgggaagtgtgtgtttcaggatgatgaaagaggctgtgctggttgtcagtcagccagtatttatttacagttttagcattttgtatgacaaaatggtatggaagaatttatgatactgatacagactattagcctctgatacagagatgctatatgtgtgtgtgactttttttctgaatcagcattttataactaaaataaacaatcatagaaataattatatatggtaatacaattatatgaaacctcaaatattctgcaatatgaaaaatatatgcaaaaattatgtaggtactcatatagtgagttctgcaagtattattttcaagacttttaaaatcaactgataatcaccattattgtaataaatataggtagattccacaatattagacataaacagcaaacacaaatgaatattttacattgctgtattacgtattctgatccaatctagcagaaggctatggaactgtcttgtataaaaatgcccctctctttatatgatcaaggatgaaaacattaaaagcctgctgtaaagctttaggatctttgaaggggggaggggaaatcagctttaaacagttttctaaggtatggtgttcattacatactggggaaaggatcataaaatatatagacatgttgaaataaaataagaatccagtttggaactatgcctgtttgtaagaccatatttcaaaaatataagagtaaatggtttctacctatctgaattaaactttaaaaaattgagaatatttttgtcaacaactgtcatattttgttatacctcaactttgaaaaatttctgaatgtgtgtgataaaagattgatgaattctaatacctaaactgattattgctaggcctcaagcatcaaaatgcctgacatgataacttttttttttcatttgtaaaagattatgtagtttaatatttggggctattaaaataagcccacaatacatctgcattttaacagtagacaacaatatttttcttattgatgtatcagaagtacagttatttcttaataaaagtatggttgctagacaggctgcaggcagtatttttgaaaaaaaaaaaaaaaaaaagaagaagtcagtgaccaggcccttcataggttaaacccttaaatgaatgacctcacctgatgaggtgcagtatcgtgttttaaagcagtcaatttgttctgcaatgttctggaaatacacgcgagcttctgttacagtgcaaggagccaaggtacacgtatgtgcagacactcacccacacacgtccctcggtgtcttctcagcaaagcttcctactgcattgtgtttcattaccatttctcctggttttaaccccagagcacattctagtttaaaattattgctaaaagaagagccaggccttcagacaaacagaatgatgaagaattagatttattatatgtaatatagttttgctagtatcctggcatctctgtttttacacacacacacacacacacacacacacacacacacacacatgcatgcattcctgacatcatcttttcctgagctgtgggattttcagttctactgcatccgctttcatggggcctgagggtcatggagattagagacggtggggtgctgggagtaagaaggtgctcattaaagagaagatgagtatgcagcacctttgagcttcatccattcacttgataggaaattacagagcacacgcttgctattttatttaattagaagcagacctttgtaaatacaaatgcaccttaaggacttcaaaggtgatttttatttaattcacataaatgtatgtaaggaagaaatgttatcaggtgaacaatttcagggctgcctccacttccctttctcccccatctttattaaacagattaaaaagctatccataatctcagggttcacctaaattccgaggccttttaacttaagctgcatgcccctccaagatgccctctgtaggaaaacaaaatgccacgcagaccttcaataaatgccagtggatcgttctccactttttgactctctcctttgtcattttggtgtgaccacggtttgctgcctcgggggatcagtgagtcacggggggcagaaccagcgcaatacagcattctggtaggggaactaattttgactaaaatatttgccaattctaatccccaattcctggacctccgggtagctggcaaggtattttatgttagatgtgtctggagtaaggtgcacggagtatttcgacaagagactcaattcaatgcgtattaaaacttgattgagagagggagagagagaggtcattttataaagaaagacctgtgaacactgtagattggaaatttatgtttgcaaaataaaaggatgggtttatcaagtggatgcatttacaaaatgtggcatccaggtttcgtaaaattagctgaattctacgggtaagattatgaatgtggctcataaataattaataggtagtgaaaaagaatgtattttgcattaggcagtgcattcaatagtatttcggaaatgagcacttcgatttcctcggtttccatgcgtggcccacctctccagagcagggcaggcacccaggggtgtgcccacacaaacaagcgcgtgtgggcattttcttggctgctgcgctgaagtgcacgctgggccttggtgcccgcaccctcagcctgggagatagggaggtggtgctacctgcaggccgattgtgtccccgccataggacactagtgggcggcaaacctcacaagactcttgcagccagccttcagcagagccagcaaacccagccgccaccgagggaggactgctccatgcagatggtcaggggctttcttctgaagacgcctcccccacgatctctcaagttcactgcgcccaaactccggcgtcgtagagttcgtctaacaggaaccgggcaaaggcaaccgcaggtcaggcgaggtccagcagcctttgttttcaactgtacagcggaggaccgtattcacagcaatatctagaaacctagaaggtgcccagaaaggaaacacaggtgttgcagcgggtagcgggcccgcagaagggtgcatttgcaccccctttccaaagccgcgagggaaccccggcgtggcgcgcgcctcggaggtggcagctccgggagcagctccgcgcctgattggctgaccttccaatgtcattccaggagccgccgcttctcctgctgatggtgacaggggtgatgctgacgtgcccgctcctccgcagtccatcaatctccgcaggcaaggctccgggaccgggagcccccttccctctcccccaggcccactggaaaacacctgttcccctggactggggggttaactcttcaagttccaaagacctgggcacaaaaatgctcatcttatctctccgcgcccctccccccaactatatttatgttcttttcttcaatgttgtgaaaatgccagaaaattcaaagttgcatttcccttgccgaatctatgggttaagataaggcagtgggaatggaagattccagcagccccacggagtatccactatgtcgttctgaattcaaagggtggagcacacggatgttttctgcaggtgacgcaaggtctgtcaaggtggcaggagggaagcagggacaggattttggttcagaggtcagacagcttctgaccaggacgttcagaagggttgggtttcacaaatctgctcctgaaaatcagttccctccatattatcctttttctaaaaatcttggctgtttccttgatggagtctgtggtaatcgttacgcctgcatttaggtgatgctgatttggctagtgactgcctctctcactagctagacaggagcctccatagtctgaaatgcgtgcgaagcctgagcgtgtccttagcacagagcagagcacatggtatggagtagtggaaatagatgatgttccttacggagtgaaaggaaaaagtgataggcagagcctttctcccctccttaactcctgtccaccttcctccctcccgtccacctctctcttctgcctctagctgattggctccccctcttagtttgctttcctggacttgctctcctggtccctatcttgcattctgactaaaccactggactcttttgctctacccacctttttctgtcgtagtgactcaatcacggtagaaatgtttattttccagaaacgcctgtggcttggggcattttcttctcttttcaaaaagagattcatatttcgagtatctgatgggacttcatcactgttgcacaacagctatgtaattgctttaggtgctcttcctgccgtgcagtgggtcaagtgtcacagacaataatttcatccatgtgctggaccccttgttctcaagtgtacgctgctaaatggcatgatttaaaattcctatacagtgtttattgccctgtcgcattttgaaagccagccagaaacatcaaaccgacatttaggttccccgcccactccgccacccccagctcttgggaattcatttcttcatcaaagagccacccaggacatcaaaacaaagcttactttctcaggccttaattcatctttaaaaagtcatactactgttttcttcagcatcctatggatttatgggttttttgtcattatctttatttcttattttgcagattcaaatatgacagttgctatcttcatcaaagtaacatgaaaggatatcttaatcattgttaaagttgatttttgtccaaatataaaaatcaaattaagtgtcttatagcttacaatatttatcagcttttgatttttggacatctctatttgttctatgtgatcaacgctgattttttaaaaatcatgcaactggattaatttttgatcttgaagccccctggattatgtaaatacatattatggtttaacagagagggatgaatgggattgagaagatatatgtcaagatatgaagaaggaaagaggctactacacagagagttagaatgacagggattaatgaatcttgcctgtatccctagttattttttttactgagaagacagtgagtaagatttaagagtgagcaagcagtcctatttatagaaagctgtttttaagtgcagccgcaaagacagtgaaagaaagaattgaaaatgcaagagatcacctccatactaaatgctagcttcccctaacgtcccagctctgtacagcattttgtaggagaaaaaaacaaaaaaaaaagcataccaacccttgcagaaatattatgaaatctctttggactctctgcagaatattctagaagtgctctcagtctttaagtctatgttaggcttgggaagctggggatgagaaggcaatatatatattatctggaaacagcttgagtaggtctgaacaaaagactggaggtgaagggaggacattgaacttgcagcactgctacaaatatttattctgcaataagccttgcctttcttaaagatgtttcacggcagaatagtaggagggtgaaatctgcatacatctcagtaataaagcaattactgagagaagagttcaaatttaggatcctgtgattatcacaagtccctccatgttaacctgttctcaaactctggggttttaaattgcaatatatgaagtccttatttgtcagtctgtgtcgggcagacaatatcaccccaggctttgtgattgacacaaatgttattggacaagggaaaaagaatgccacatgctcttataaatgaaatagtctttataagattccatatataagtgagatcatggattttgtatgtgtgtgtctggcatatatcacttagctaatgtcccccaggttccttaagtatatacaatttagcataaaaaaagaaatgaaatagttttcctttctaggcctgtatttgttacttatagcattctggttttcctggttccaagtgggctttgggttttattaatagtagaatcgttgaatttttatgcaaatactgctgatttacaggttggaaatctggacaaaatcagacctgccctagaagatgatgctgtggaaagtgtttgccttttgtcttataaagaaccatctataaaatggatcattttgtcgctagtctctccagactatgaaattggcattttgataaggtgatggaaagaaatttgaactatttaattactgattttgattcatacaagccttgactcttttagtattaaaatgaagaaacaggaaacagttttaagtctggttttacataaaatttacacttttttcacactgaaaataaaacagtaaaagccagcttatagttctttctaaatatcccaactttctcattattggatgcttctgcaaaacagcagtatggtgataccactcccagtgttgaccttgatgacctgagggtcccaaagtggcttcagcattatcatggagtcaccacaatgatcaggtagaagctggtgttaggaccagcgtgaatgggtcacaggggctgaggggggctgttgggaggtagcccatgccgtatactgaagagccatccatgccacttcaggtgggtgattgcagtggactctcttaccattgattaatcttcctaatattgagtaaagcattgattcttctcataagcatgaactgctggatgatgggaacatttctgtgattgtatcataagagaaagacaagtagaaagataattagaactgctgcaattctatgtatattttaatttaatttatttttttaaatacaaaagacagctatatttcctatataataaggaaacttattactttaaggaaatatactttctcacgagagaaactcaagattcaattcttttcacagttagccccgctgtggtgtgatttgatcttgggttccatagagatacagaaaatccaagtcccagtctgcttaattgccatgtttattttttaatctcggctgtagagcatttttaataactgatatgtagcttgcagggtagaaataacaatgctttggaatattacctgtgagactttaggaatgagctgaagacacccaacaatgacaacaatggcctctaccagcaaaacgggaaccatgactactttatcactcctgccggatctagttcttgtcagttcctgcaaaggctagtcacttgtctatttcgttggctagtgaaaaggaaatgcacaagaaatgtggaatgctgtctaacagacagaatcctcctttcacaagttgtttaagttggcagcccaagttagcaacctctatccgggtccttaacgtgacagcagaatgtgggtaggatggttaattaccagatgtgtctgttatgactcacccaaatcaatagctattaaatccttggtggctactgttttagaataggcttcattgaatatttgtatagaaatctgggtagaaaaatgtggacctcgaggtgatctaggtatttgttttgggcaaggaactctcatcagtggttggtttatttgtgtcttgggggatctcacatcatcagcctttattaatcacaggcacgaggggccccacactctcccccatacctctaccgccccattgctgaggatgggagagtaagaatatagaatatgctgtaggcttctgtgggattagatgcttggaggcagcggaggcaaatgttcatgggaacactgaatatggaggaagaggctgtgccagccccatagccacacatcccctccacccttacatcaggataagaggtagaccacagtctgttgacacttcaagctgaacattagttagtatccttctatgtgggccttcccaggtaaggatcgaggacactggttctcaacaccccggtgttctgggtcagggagaacagagaaaggagatatggaagtttcctgaaatgcatttcctctcattagcctcctgttggaaattctgatgccagcgttgtggggaatgggctgtagtttggaaagctccccaggtgtttctaatcccatgtgactttgtcttgtttttcccaccaccactggggtctcccaagttatggtttccatgtttgttatgtcgtcttccagctctgataccagagagtctgattctgtagccttggtgtatgcacgacctgtgaatttgcattattaacgcatgcctttgcctgttctgatccacatgaaccataattcacctttgcaaaacacacacttgcaaagaagctacccaaacagtagctaggaagttgatccagtaaagttccaagtacatctcgatgaactgttggagaactctgtattgggtagtaatttattgggaatgtctgtatacagggttaggtcttcactgaccaccataagaatttgggcatctttcgggataattggtgctggggtttagtaacaagaaagattctgagtagaggggtatgtagatcctgccagaggcactcccaatgtggatgctagcagcttacgaatcatctgtgtgtattaatatctatctctttgcaccattttttcttcctgttagcgtatttgatattcaggtttataaatgcttgtgctttgcttatggtcttgattccattgtatttctcacattggtcccttcttcgatagcagctggagtcccagcagagaagccctttgaaacctgcctgtaaccatgaagctccaggcaagagatccatagtgggaaaccatttgggtaactctactgaacaagcttaagagatgagctagaacgggctgagacagggcaggagagtggatctgtttgcagctagaggttttgctttgatgccgccttgggatgctgcacattcctttgtccagggcacaagctcattccagagccagatctgaagggctttgggtcatttgctctgttggatgttcttggctttcttttaggtaaataatcacaagttgactgtatttaccatacaaagtatatgtcattatcctaagttgtcagaaaaaagagagaagctggcatataagggcatatgtgcattttaaaccttgttacatatatgacaaaatagagggcagttattggtggcagattaattttttcaaaacatcgtgtccttgattttggcactaaaatagactcaaatgtgtgctggagagaggcctaaattcagaaccttaaaaatacctttttgtgtcctgagatcttattttagataatattaaaaataactttccctcctaggcatcttaaacaagtttgatgttataatcctttggtgattttattgtgattcactatagaaattacctttttgagtggccgttttgaaatttagctttagaaggaaatggtataaaagccattgtaggctgaataaatgtgaattctgcttactcatcactacaggaattagggtagactgtctctttacaataatagtttcctatactcatgttcctttaaaagggggtgggggcattatattaagaagtcacaagctctgacaggggaattgcagaagaagatttcagtttaaaatagctcacagttcctctctgatttggagttttcacaacctacatggtatagcacagactgttctcttttaaattttgtagtagagtaggtcaatcttttcccatctttctgccacggaaagggcataaatatttccatcatcagatttaataacctgtgttagactcatgagtaattgtaaatggtgaaacactttcttcataaaaaaaataaaaatgagagataatgtgactcagtattattattagaacaaatcaccttaacccatagaaaatatttctttcctgcagcaataagtgttgagtatttttccctggggtctctagcatctcttgataagagtgaatattgttaggtccagcctgactggtggccaaggcaggttaagtttatgcaatgagtcgattgtggtggagatacatttgcaagaaatggaggagcagtcggcatttcacctctctccatcttgttcacctttctctctccctctttagaaactgggagcaaatattagagcttacatgtgctcagtgagagtggagggagaaagctgtattttcctggggggtctggaggccttctctgggtttattcattttcaaagtcactggtggtttgctctctcctgggtaggtggaagacattgctgtgacctcttgcctgctcagggcacactgaagtctagaagcaagggttggagttctctgagcctgtgagtgtccctattcaaaggtgctcctggaagtgtctccctaaaggtctttgatggaggaggctggtatttaattatttttttctgaagtgcacaggcataggcattatgggttattgtaaagctctaaatagagccatgagaaataaggtaaatccatggaactgggcaactattattattattattattattattattattattattattattttattattattattattttggagacagagtctcactctgtcgcccaggctggagtgcagtggcgtgatctctgctcactgcaagctcagcctcccgggttcatgccgttctcctgcctcagcctggcgagtagctgggactacaggcacccgccaccatgcccggctaatttttgtatttttagtagagacggggtttcaccatgttagccaggatggtcttgatctcctgacctcgtgatccgcccgcctcggcctcccaaactgggcaactattattttaggctcattattttttggcaaatggaaataaaaagactcctcccctatttttatgacttggttacttttaaaagaagtatgcaccggacaagctgtgttcttcagtggttcttaacggagggcaattttgcacccacagaggacagtgagcaatgtctggagacatttttggttgtcacacatctggttgggggttgctactggcatctggaggggacactcactataagatgctcaacaccctgtaatgcacaggacagctccccacgacaaagaatgatccagttcaacatcttcattgtgccaaggttgagaacacagacttaaatagctcagagtctagttaccgtaacatcagtactgcgttttttccatggattttagagtggtcctggagagagaggaggaaggaaaatgtcatgaatctcagttgcaattcctttggctgctaaaaccatagctggtgatgcttgtcattgattaactttatttgctattttctttcttttcttatgaagaaagggaagccaaatctgtgttccctcttttgtcattaagaacatggatgctcagggtgttcctgggttcctccagccatttctccctcaagcaattatgctaattagtgtttgatcagatgattaaattataatgtgattaatcctgtgtgctaaccgctctgaatgcattttctctcgcctggttgccctgtgcctgaagcacccttttctgcggctggcggaggcctgtttttcctgtggatgtggatttctgttttcaaagcactgcaaattctctttgttgcctggtaaaagggagaggggatatttttgtaacctgttctctcaggcaaaggctggactggagagacctctgggaaatattgaaaccgtagctagaaagcactaatgatttgaagatactagatgtggagaaacgcttgaagaggagagtgcagagacagctgtagtggctccaaagtccatgaaatctttttctctgagagacttttcgctgtttgccttcctttcccttctgagtgttgcctaagtctctgcctcttgtgtatgtgatggccccgggaggggtgttctcggtttattttaggtttatatttccttaaaaaggcacgacatcatctggttttgttttctgataacacagtttaggtttgctcttgcatgccgtgtactttagactgggtgattttttgaggtgaggttcgttaacttaaaatgttgatgaaatgcttcctaatgtaagaaaattgggactgcataggaaagaatgtgagtagaaaatatcgatggtggtgttgtcattgatgggcttcttctctaaggctgcagattaccatggctcattgtgtagtttgatgagcttagcagtgattgaatttttccttgcaccctatcactttttctccctttatattagcttaatggggtagtctggatacaagaaataagagcatgtagaatatgtgcagttttttaaatcagaatttgcctgtgttttgatctggctggaaacgatagcctcttgcgttcaagagcaggtcacacgatgataccatatattaccattccagcttcccgcatcctaagaacccctgggccacaagaattactcatagagagagtaattatctgcatagattgtcacataccccttcgaatattgtgtaatctccttcatagaaatgaaaatctcttggtttgctttgaagaaagatatcctccttgtaattatttccctaaaaaagaatgagggtaaaaggaaactcgtatgtattgggcatctaaagtgtgtggacacttgagtgaccatttgattcgcactcgttatgtttattagctacaatagtaatgatcataaaaacaatagcttgaatttatgatttattactagatgtgaatattgttattatgaccatcgtaaagaaggcatggttagacaatgtgctcatggtcacacaattgttgaatgacagactgaggactacgcctctgttcattctcagtcaaatgggtatttttaatttcagttttacagattgcaaaaccagggtttggaaatgttgactatcaggccctggtcaggtggcaactgtgatttgagaatagcactttgagcccaggttgtctggtgtcacagtctttaaatcttctcccaaatcaagccacattcattcatttgaagttttcaagctgaaaatgattatgttaaattttctttaaagagttgttttgggaaagtgaaagatcggtttttaaaaatcggtgtataaatggaaaattcatttacttttccatgtcagccatttcgcttacttaagttagataagtaagagacaggttaattaactcttacccacttcagaggtgcaactatttcatgagattgcattctgttgggaagagtaaaattggagaccagatgacagttatattacattcatattacaggatagaatctttccccaactctcaaatttaaatcatgcatctgtttttaagtacactctatttcatttgtcctgaactgactaccaattttctcaatgccaaaatatcagaatcaaaatatttttgaaattgctaattggaggctgaaattgtgagttttgtatcagtttgagcttttctgaaaaaacacccaaattagttttgttagtaagcgtctgaatcttattgaagctgaatcattttaccggaagtgtccatgggacatgcgtcttaaagagtttagaaaatactgcctagacatttcagcctgactgaaagctcttgtaataaataagaataagctatgcctgtgtgtgcctgtgtgtgtgtgcatacctgtgccacgctatggtgatattcttattactctctcacactgagttaaggttcaagccagctactcatatgtgatatatgtcttctgagaaaggacatttgccttctgtggagtgtgtccattgtccaaatgtgatgaaaatagaccagttctctcagagctcagagcttccctcggctgctggctgcaaggtggtggaactcggtttattgcctggttggcccctctgcaggatacacactgcgtggtgctggttggaatactgttctaatgaagtcaccatctgggtccactggttggtcccctgtcgtgacaattgccttcatcctgtccaatcagccacctcacaaaccttggccagggatcccatggagagtctgactacagagaaatttaaagatatttgtcttcttgtctgtggcctaagcagcctgaatttcatactatggtaatactgacagaatcacctgtttatggagtggtgaatgaacctgtttatagtaattgctaatattcattgagctcttattgtgtgccagaaactgtgctaagtgcttttttctaccatcccatttaattgacaaacaagtctttgaggtgcctgttggtattatttccactttacacttgcggaaattcaagacttacaaaggtgaatgcctttcctagagaaggcatacattgagccggggtggaagcaggatttgaacccgggcagtctaattccagaactcctgcacttgacttccaggctgtcttcctggatgaatgagccccagataggtcagctggtttctgagtgcacatactatttagagtggtgatatagcttggatatttttccctgcccaaatctcatgtccagttgtaattcccagtgctggaggtggggcctggtgggagacgtttggatcacggcttggcgccatccattaggagggatccttcatggcgtggcgctgtgcttcatgatagggagttctcttaagatctggtcatctaaaagtgtgtggcacctcccccacctactccctgtctctcttgttcctgctttcaccctatgacctgcctactcccctctcaccttccttcatgagtgtaagcttcttgaggctttcttagaagctgagtagatgccagcaccaggcttcctgtaaagcctgcagaactgtgagccaatgaaaccgcctttctttataaattacccagtctctggtatttctttatagcaatgcaagaatgacctaacacaaatggccatgcttatctggaaaactggaaatgtaagttatggggagagttaagaggagccagatagcaaacatggctttcttaagcttttctgaaggaagatgtgggaaaaaatgtggcaatatgagaacaatttgggagtctcagggttggtttgttttcatcccagcatttctggaatctcagctcattcctgagatgagaggctcagtcacgaaaacattgccaagcacttgtggcctctcccatgcaactaagcacctggtcatccccacttcccaacgtgcagcatgtgtcacccatcttttcatatccatttctatggtatttggattaaaaattaaaccctccaaatttcagcagacaacactaggtgaccaccacctgtctgtagtgatctcgataccatcacggatctatctcttgacagctgactccaacgccaacttgcttttcctctgacctgtttcaccaggtgctcacacctactcacccatgtctcagagactatagactttgtgatatacctgattatacagccccagcctatctgccattgcatcagagcagctgcacttgaccaaggagctctcgctgcacacactgtgctctgactggtctcattatgcatgaccacaaacctcgagtgggctcttagctctgccctcaatctacctcactgccctagttgatttctgtgtctgtgggaagactacttcacacctttctcacctccccaaacctcaaactccccttcctttcccagactctgagtcgataacctcatatgatttactgagaaaaccgaagaatcaagtgaatacttggactattccctgctctccaatacacacccacacactcaatttttcatgtgatcagcgtccactcctgtttttattgcctccctttcaccccactgatgatgggggattcagttataggggtggttgaacacatgaccctgggcagataaaattgacagcagtgttgcattcaagtattcccacagcccaggggagtaggacagggcaggccatacagagtgaactagcaggggctgcgggaagcagaccttgtagtaacaagaagggatggtggccgtgtgtgcacacctgtaatcccagcacttcaggaggccgaggcgggtggatcacctgaggtcaggagtttgagaccagcctggccaacatggtgaaaccccatctatactaaaaaactacaaaaattagctaggtgtggtggcatgtgcctgtagtcccagctacttgggaggctgaggctggagaatcacttgagctcagaaggcggaggttgcagtgagctgagattgtgccactgcaccccagcctgggtgacagagtgagactgtctcaaaaaaaaaaaaaaaaagagggtggggtgtcccctggttcctgagggaggatgtgattggcttatttggctgattccacaggctgacgggagaccgaagcccactactcatgggtaagcaggcactgtgcctggtccctatgagcggagtgccatttggctaggggactttatccatgacagctcatgggtgggggagaactagcaggtaagccctttgaggctcttctgaatttatcccgttcacagcaacacaatatggaaccttaatctcaggtcccacaccagacccatacacatgaccttcgctactgtgaccatggaagccctggccttgctcctgttgaaagctgaaacctccattcatgtccagaattccacatctcccatctgcttaaagactttgcccttgtatttatttttatttatttatttttatagaaacagggtctcactatgttgcctgggctggtcttgaactcctgggctcaaacagtccccccgcctcagcctcccaaagtgctgcaaatacaggtgtgagccactgcatcagtcctgcccttgcattttatctcagcctcaacttccccctcttccagctcagcatatcaacattctgttttctctctgttatccctaccactgtaaaacgtactaacaaccaccacctcccatcttgtcaccacttccttcttccatccaattcctctgatactttttaatagtaaaactactggaaagaattgagtatactagtgcttctcaaactaactgtgctgaaagatcagtttttcattttccaatctgttgcagcttgatgtgaggtccttacagtacttgcctcaaacacagcttgttgctcatgcttcttatcacatgagttgaacgatacacaaagttgcctgtaccgcccttcctgagaatggagcccactgatcacccccttgaatgttgcagcaacttctcagtttctgtgcttgtctcactgtagacaagaaacaagcagctggtctgtacacacttcgattagcgctgtttcaactcacctgacactctcatctttcagtctctgttgaacacacactgatcaggtcttcttcaccactccattgaatctgcttttgtcaatgaggctgatgacttccacatttctagtcttctttttctgtttattttctttctttcttttcttttttttttttttttttgagacatggactgactctgtggcctaggctggcatgcagtggcacaatcacagttcaccatggcctcaaactcctgggctcgagtgatcctcccacctcagcctcctgagtagctggactacaggtgctgcaccaccacgtccagctaatttttaatttttttgcagagatgggggtctctttatgtgctaagattgcaggcatgagccaccacacatgggccacgtttctagatttcctcatgttcactctctcagcagctgtgacacaacagatcacacttcccttcctgaaacaccttcacctggaccgtgcacacctcactctctgggtttccctctgcctcactggcttctccttctcagtgtctttggtgagcttcttccctctaattagactctaaatgttgcagcccactccagggattaattcttacccctctcttctcctctcctttcctctctgcttcctttcccttcccttcctctctctaattcctctctatataatttaatttaggtcaaggcattaaatgccctctctatgctgatgacttccatattcgtatctctatccatgatttcttctctgagctcaaatccagatcctgaaatccagctgcctactcaacatccctttacaaaactcacaggtatctcaacatttaaactctctgaaggaggccttctggattttcctccctgtaaccacttctatctcacattttggtcattcaaactgagcatcgctcgtccctcactgcacagaacagaaatctcagagtcgtccttgattcctctctgtccttcacatcttgtattcaaaccaccagcatgtcctagtgatgctactttaagaatctgaccatttcttctacctttaaattccttcaagctgcgttctcctttttgcctggactatcatgataatctgccaactcacagctgaatttccacccagtagccaagggatttcctcaaaatataaagcagattacatcactcctctttccaaagcctctcccttcatccccaaaataaacacagcattgcctacacctcaaaccccttccatggcctggcttgggctggcccaccccaccccctccacagagccatgctggccacctggatgtttctacagcttgctgagctggtcctctcctcagcactgcactggccgcgtgttctgcctggaatgctctaccctggccttttcccgccccacttcttcacttctttcagttctctgtccaaatatcaccacctaagagaggtctccctgaccacctgatctaaaacaaagtggcctccttgattgttcagtttctccttgccatgcttcaggtttctttgtggaagtcagagtacttaaaatcatatacttagaagtttatcatctgtctctcccaactggggaagcccacatttgtctactgtgctcacctagaagagtgactaacaggctgcaggtgcccagtaagtagttactgattgaataattaaaccaatgaatgttgtttaaagcaatgtatagctcttagggactggatgtcattgctgtctcttcagttctactttatttatttatatttctgatggaatgacagtatatctctgtgtgacaatagtttctgcatttggaagatctgcacttgtattttaattaaaagatcaacaagcattatgccctagaattctcaactctcacgcacccataaaagatataacaataaaaccccttacttaaaaaaaaaatctttgttgactacccatgtaatttctgatatgttgtatatactttgaggaatacaaagatatttggttcaaaaatttttgaaaatgtttactgaggccaggcacggtggctcatgcctgtaacccagcattttgggaggctgaggtgggcagattgcctaaggtggggagttcaagaccagcctggccagcatggtgaaaccccgtctctactaaaaatacaaaaattagccgggcgtggtggtaagtgcctgtaattccagctactcgggaagctgaggcaggagaatcacttgaacccgggaggcagaggttgcagtgagctgagatcgtgccattgcactccagcctgggcaacagagcgagactccatctcagaaagaaaggaagaaaaaaaggaaggaaggaaggaaggaaggaaggaaggaaggaaggaaggaaggaaagaaagaaaatgttcactgaacacctatatgcactaaactgtaacatccaagaaagcagggattttgtgttgcccattgtagtatcttcagttcttagaacaaggactgacacgtaagttgctccctccatatttgttgaataaataaatgagaaaaaaacactatattaacgactgtgcaagaaacaaaacaacttcctcttttctgggtcatggcaaagtctccaggacaataggacatgctcacagcttctaaaagggtgtacccaataatgaccaccatgtcggacatacagagaaagctctgcagtgtttatggaagcagaaaacaacttctgattagcctatttaaaaagggcttcaaagagagggggatttaaaaactttacttttaaggttgtgtatgcttttgactgggaaacgtgggcagtgaaaagattggcaggagaaaagaggaaaatgagggaagtccccgggtgtggagggagagacacagaattctatcaagctgctgtgcaaagtcatggtggaagacacatctaaaaatgggataggggccgggcgaggtggtgcctgtaatcccagcactttgacggggccaaggcaggaagattgcttgagcccaggagtttgaaaccagcctggaaaacgtggtgagacccaatctctacaaaaatattttttaaaaagtaagctggggatggtggcctgcgcttgtggtcccagctactgaggaggctgaggtgggagaattgcttgagcctggaaggttgaggttgcagaaaaccatgtttgtgccactgcactccagcctgggtgacagaagtgaggccagcttctgtctccaaaaaaaaaaaaaaaaatcaataataaaaatgggatagggagcagattgtggaaagatttgaattcaaatttagatggaattgaattgaagattcgtgtgttaaaatgctcatctctatttgagcaatcaatgcagtattttggttgccgcacataagagacattggagagcagagagaattggtggaagggtggccaagcaaaggctaattccacggtgccggggtgagatgatctgccactaggacagtgatggcggctgggtactgacctaggtgggaggctgggggacagagggagcccaatggggatgatccaagcatgactgctgataaggttgggtctagattatccccatggcggtgtctcacaatgtgagtttaccgttaaactaaagctgtggatagattttatagccttgtgtgtttaattactgccaatattgcctactttttttttttcttttgagactctgtgaaatttgcgtttctgcaaactatgtgccagaatggagtcattgacagggattttataacacctgatgagaattattctataattttatcacagcataacccaagagatgctgaaacctgactgcattgcaatatgtatggatcagagggcacatcctgaagggctaatcagcttcaatcaactcataactgacaagtttaatttcttctgttttttgtatttctcttgaaattaaagtatacaaaaatgtagtattgacagtgaatttgggtgaggtttcactgtagcaatcaccatctattattttacaaatcattgggatcaattttggttcctgttagcataaagctatttgggtttttagtaaccagaaaatgaagggttaagcacacctataaatatttatattttttgttatgtagtataacttggtatcacccaaatatccattttccctcattcatatcctgaaaaattttaagtttaaaaatgtgttccacgttgtgagttttgaaagccttaaacaagttgaattgagatttacaggattcaacttagtgtaactttgacctcaaaataatttacaattcatttcatatttcacatctgcagcctcactttttcgttgagcagcttaatggtttttttttatggtttatctgtttttggcctccttgtctgtcttcctttctctcctcatcttgcacacttattgacacacacacacacacacacacacaatgtatgtatgctaagattaagcattctttcttttttgggggggcggtgctggggggctggtgtctcgctttgtcaccctggctggagtgcagtggcacaatttcggctcacggcaacttctgcctcccgggttcaagcaattctcctgtctcagcctcccaagccgctggaattacaagcatgaaccaccaagcccggctaatttttgtatttttagtagagacggggtttcgccatgtgggtcaagctggtctccaactcttgacctcaagtgatccgcccgcctcggcctcccaaagtgctgagattgcaggcatgagccactgagccaggccgaagtgttatttcttataagaagtttatgtgtaaattctttgcttttgtacttattgaaaaagttatagttttgtacttattgaaaaactgaaaataaagagaagtagggtttacatattgtatatacccatctcaacgtgatacagattgtgaggaactggcactatctaagcagggtgatcatgatacagaatgttactaatgttattaatgaccgaagatgaaaccagtgtaaactcaccaatgggctttcttagaaggagagcattcattaacctgaaaatatttactgtgcttattttatgtccattgggaatatggaataagataagcacagtataaatatggtttcttagttggccatttcattaggaaattatgacatagataagtacaaagtaacaaagtctttttttttaaaaaaaaacagaggtaatataagctaataaaacaaggagacaaactgaataatccaatttagttagattataaaatgagctcctgatcattctaaaaagacttttttttttttttttttttttttttttgagaaaagatctcactctgtcacccaggctggagtgcagtggtgcaatcttggctcgctgcaacccctgcttcccgggttcaagtgattctcccacctcagcctcccgagtagctgggactacaggcatgttctaccatgcccagctaatttttgtacttttagtagagacggggtttcaccatgttggccaggctggtctcaaactcccgacctcaagtgatctgcctgcctcagcctcccaaagtgctgggattacaggcatgagccactgtgcccggtctttttttttttttttaacttttattttaagttcggggatacatgcgcagatttgttacatggataaacttgtgtcatggaggtttgttgtacagattatttcatcatccaggtattaagcctagtacacgttagttatttttcctgatcctctccctcctcccactttccacccttcaataggccccagtgtgtgttgttcctctctatgtgcccatgtgttctcatcatttagctcccatttataagtgatgacacgtagtaggtatttggttttctgttcctgcactagtttgctaaggataatggcctccagctccaaagacatggaaccaacctaaatgcccaccaataatagacaagataaagaaaaatgtggtatatatataccacggaatactatgcagccataaaaaggaacaagatcatatccttttcagggacatggatgcagctaaaaatgttaaatataaacatagaggagaaaggaagctttgtgaactgtacttcgggagggctttatggaagtgaagctgttgccacagaatcctagggaacatggatcagtgctgtcctgcagtttgagaagagggctaggcattgaaagcactgctgtggggtgtgtgtgtgtgtgtgtgtgtgtgcgcgcgtgtgtctgtgtgtgtgcatgcatgcacataaatctagagactgaatggatctgaaggaggctgaagagcaaaatccaggctgcagtgagaagcttttaaggactctcagagcaaagctgtgtgcaacagagctaaaagataaaatgaaaaatgtactgactcttaagttgtgaaaagtcaaaaaagacaatttgacaaactcaaaacagtgaagatgattcaagaaattagagtgtgtatatatatatatgtgaagatatatatatctatatatatgtgaagatatatatatctctctatatatgtgaagatctatatgtgaagatatatatatctatatatatgtgaagatatatatatatctgcgaagccctccccaactacagttcatacatatatatatatgtctggatatctggtttgggtacaaaaaacttgctgtactaaattattgataatatattttaaggcaatttactaagttaaaagcataataaattataatctattattgtgctctagagaagttattgcttaatgaggaaattaaggttaacattgaaacctgggaggttctgatgtttaagtgggcataaatcttgaatggagttaggctcagggccacactgggtgatttatccaaattcactcactcttgattttttgtttttttctttgaatttttacatggctatggagttcaaccataagataatttttttctgtaatacatatttatgaccctaatttaaaaaaattttattttactttcagttctgggatacctgtgcagaatgtgcaggtttgttacagaggtatacatgtgccatggtggtttgctgcacttatcaacctgtcatctaggttgtaagccccatatgcattaggtatttgtcctaatgctctcccccaccttgcccccactccctgacaggccctggtgtgtgacgttcccctccttgtgtccatgtgttctcattgttcaacttccacttacgagtgagaacatgcagtgtttggttttctgttcctgggttagtttgctgagagtgatggcttccagcttcatccatgtccctgcaaaggacatgatctcattcttttttatggctgcatagtattccatggtatatctgtgccacattttctttatctagtttatcattgatgggcatttgggttgtttccaagtctttgctattatatatagtgctgtaataaacatatgtgtgcatgtgtctttatagtagaatgatttataaccctctgggtatataccccgtaatgggattgctgggcatgaccccaattttttacctaagagctttttatagttctagctttttttagtcacaagcagggggcctttatttatatatccctacacacattatttttctccataaattgtcaacttcctgccttatcccattcctgatgatgatatcctgttcttgggaattaaggccctagagccctagaaccatcaacagttagacatggaaggacctttgttaattacctgtcaaaatcttctatttgaaagataagaggggagtgaggatcaaagatgtaaattgacttctttaatgaggcacaatatgagtggaatggagctggaacccaaaccaagctggcctatctcccagctctagacagtttccatcatggcaaacatattcatgagaagaatgttggaagaaattagaaattcgcatataagccaatgcagatcaatatatccatgctagattgcgtgatttatcacaacagcttggcccacaatgatctcgttggttgactgagatgggccttttttacactcaaaatttgtgaggattagtaattatatggcattagcattatgttcctaaatttatggctcagtgaatgctaagtatgcaattgggaacgtatacacaaccattatgtgtttggcccttgttgtttcctgagactcaacatcttatagggtgaaaatccaataatgtgttttgacgacatagactgcccccactgtctggggaaggttcacatggggctgaaaagctcccctgcctgggtgcagcccagcacagtgctgtggtttgaggcaatctgtgttcaattacggtaaaatgttaaattagctgaaagagaatttttctggtcacttgagtctgccttttggactccattaatcattcaatcattaaatcatttatattaaccctttctaaccagtcctaaaataatcagctttgtgttccgtgtttttcctcagttagattttcttgggcaaatagccctgggccccagtgaagaatccagcctaccttaggtgctcagtcagtgttgagcaaatgggtggatggctgttacgcaaatgggctccgtgtagggcttattagacctcaaatcctggtttcctgtcatacttcaacaggaaatgctacatttgtacttcagatctaaattttattttaaagccagaaaaagctctttttatataaaataattatgtggttattttaaagtaacaatgtctcattccaaagaccatctctttccttttttggttcagctgtgttttagacattatctaaatttagtcgttctcttagattttatcacatcttcaaaaaatgctattttagagtaaagaatatttttaattgttctgttcttaacctcagtgtccatggagggttggagaagaagcaacatatatgaagctgaagattgatttctaaaccttcagttaacgttggctttccaagagcaaatgctcaagcgtgggataactatcttatgtgactttgtctttttttttttttttttttttttttttttttttttttgtgagacggagtctggctgtgtagcccaggctggagtgcagtggtgcgatcttggctcactgcaagctccacctcccgggttcaggccattctcctgcctcagcctcctgggtagctgggactacaggcgcccgccaccacacccagctaattttttgtatttttagtacacatggggtttcaccatgttagccaggatggtctcattctcctgacctcgtgatccacccgcctcggcctcccaaagtgctgggattacaggcgtgagccactgcacccggccgactttgtcttttttttaaaaagaaaacaacacatcgcatgggggcggggtgcctccatccaggcagtgttgcagggacaggcggatgtccctttaccacatcgaggcccaaggagctttcatcaccgggagcttcttttttttttttttttttttttttttgagacggagtctcgctctgtcgcccaggccggactgcggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaccgggagcttcttgaagtgatgaaccacgcagtgttatattccttttaccttctactctgtcatataaatgatgacaaattgcctagctgtaaatttgaaagtccctaaatggcatttttgtcaaagccttgagaacaaaatgcttactcggagagatttttaagtcttgggagacggggtggcggggagcaggcctaattattatgcatcatggcacaatgcattatgcatcacgcttgcttttctgctttttaaacacttgttatggatgatgaaactaatttaaatggacaaacagggcgctctcctgcacattactcctgtgatgtcatattcttcttccaggggatttcatcctgcttcccttggaagtcccccagacatgcacattttaataagacactttaataattagcttagagataattgtcagtcaagggaaaataaccttttatcataggtgccttgaaagtggcctgttccagagaagaaacaagcgatctgatttgcacttaagcttgcttccctttccctcctggcatttatgtggaataaaatactacaaacgggggagagtgtaaaaaaaggaaaagtgtgggtgtggaaggggaagccggagctgtcaaattgttaagacaaatggggcttagagaatcctaattaaacctgaaattgcttagaaacaggaagtatgtattcctaattgttggcaccaaaaaaaaaaaagaatctaatttactgcatatctttaaataagaataacccattatttggctgaatgagaattcaatccttacctattgaagaggtgaatggcgtgattttaaaggctatgaaattcacctccaaagttcatcatcagctttagagaatgtcaaaaaagagcgagctcgaagccatgtgtagaattttttttttctttttctcataggtgtattctagctttattttggggaaactttagtctattgagacctttagaaatattatttgggtctctaaaaaataaatatgggcatatagtctcaagactcaacagaaaatagattcattttgaagacaacccagcagcgttgcttaataagaaaaaaaatgtatccccttgggctaggacttcagttcctgggaggatgtgaaagatctctattgcagatcgcagcaccagtctttcctcctgttattgtatcttttgatgcagaggatcaaccacccctggtttttgttgttgtttttattgagacagagtctcgctcttgttgcccaggctggagtgcagtggtgcaatctcggctcgctggaagctctgcctcctgagttcaagcaattctgcctcagcctcccgagtaggtgggactacaggtgcatgccaccacacctggctaatttttgtatttttagtagagatggggtgtcaccatattggccaggctggtctcgaactcctgacctcgtgatcagcctgctttggcctcccaaggtcaccccctctttttatttgggggtaggaagggcatctagcatcccgacacctcaaattcatcatcacatggtgcaggacagaactaaggacaaattaggaccctttctgagcctttgctcaagcttcaaatcacacttcttctcgtttgtacagcacttatagcactttgactttcatttatttaaaaaacacattgaatatgttatccccactttttagaaactgattttgctgttttgacattgtttctctagtagacgggaagggataatagattggaagcaggaactgtggattctgcctgtggttgcctctctgactttgggatctcagggatgtcagccacattgcctcatctgtggtgacaaccacaatggtgacaggtggaatcatgatggctgcaaactactgagcactttctaaatgccaggcactgtgtaggatctttcatcatcacatctcagtctcactgtagtcctctctcccctttacagatgagcaaactgaatcacagaaaggttgagaacattgctgaaggtcactagaggtgtgtgttcagtttgaatgcagatcacctgacttcaggaacagtatgataacctaaatccctaaactcatatctcccatcctgtctacctcacaaaattatcgtaaacaacaaagcaaacggccataacttaggaaaaatactttgaaaacaaggaagcacaccctgggtgtgtgtgacacttccattattatcactttctcagcatttcatctggaaaacggacgtaatcacagttgccctagaagacagtggtgctcattacatggaagagatttgattagtggtggaaaattttgtcttttaatttgtccagcagagggttggtgccagctttatcctgggagacaaagggacctacatttgcttatatttgctgactaggttcttgtgtctgtgtgaggggcagcctgcctttaaggcattatctgtgtcagcccaggttgagggcttagggatggaggctgctggtggaaacaaatgagctttgtttagggggaaaatagccttatctcgtggcagtctgtcccttcctatttgttctgagaaaatgaccaagtgataggcccttcatcatgtacaaacactctttagattggggttaccttttttctttgggaactggaactaacaaaatggcaatgacctgaaggttgagaatgacttctcctctccattcagcccctaccctgtcagctgtcactgcctgcatcactgggctgcagcatttcagcatcttctttctgaagcagatcaaatcatgcttagaaaatttgatgtgtggcccttctcaagggcttttcttcacttgtttttattttgaacttgtaaattgctatcacattttcaaacactgcaatcacctcgctaattgctgtttttcatgaataagaatacaagatcaatggccttttcaatattttcctttaccgtgaggtaatcgaaggtcagtacataaagctcctgacatttcagttacctgctcttcctcctgttaactggattacctacttgcctcttgtggttggtcccagtgtttttatttctgcctctgcaattgtcagggtgtggttccaagtcaatcacatctgcaggtcaacgtctcatcttcgttttccattatatccttttcccgctcttcttcatgattaactaaaaccccttgacaacaatgatctatgtatttgtcaatgttgctgctaagcctttagcatcaccacggtagagacagacagctcccttcctcatcaatccttgtgtttatgtgagcatttaaaatagctattagatgtaacttagaaagaagcagtatttcttttgtcacagcacatcttttcaagagagattttgcacttctcactttggtcctttctctactacgctaaggtgtgggacttcacacagattgttcttacatttttaatgaacaacaatagtaagcaattaagaattttagcttgagattaaatattgaaaaatgtcactaaaagagttacaaaaagtgcaactggacctgtgcagagccagagagtctgcatggttctgcggttcttcatgcgcaggagaattacacagttggcacatcccagcccatgctggaggccacaaataaagctgttgtttagtatgctccagttgcattttggtcacatgtgcttatattaatgcctttgctttctgcttcctcttgggtattatgtggttgcttggctgcaacagtgaattccagctgcattgatgaccactggaaaactgcaagagaccaaaagattcagggaatcgagcctgcctcatacccctcataaagctggaaattaactccaaaagaaaccgtcaaaactggctgtgctcaggggctcatacctgtaatcccagcactttgagaggccgaggtgggtggatcactaggtcaggagttcaagaccagcctggccaaggtggtgaaaccctgtctctactaaaaatacaaaaattagccgggtgtggtggcgggaacctgtaatcccagctactcgggaggctgaggcagagaattgcttgaactggggaggcagaggttgcagtaagctgagattgcgccactgcactccagcctgggtgacagagcgagactccatctcaaccaaaaaaaaaaaaaaaacaagaaagaaagaaagaaatcctcaaaactatacaaatatatggaaatcaaataatctgctcttgaataatcattaggttaacaatgaaatcaagacggaaatttaaaaattctttgaactgaatgataatagtgacacaacttgccaaaaccactgagatacagcaaaagcagtgctaagagggaagttcacagcattaaatattaaatgctgacatcccaaagcctgaaagtgccaaatagacaatctaatgtcagacctcaaggaactagagaaacaagaacaaatcaaacccaaataatacccctgtcttcatataccacagttatttagattaatcaacatatgtgtggtctcataggttctcttgcccaaccatggtttttaggtcagagagatgtgggttcaaatccaatcaactcttccctagccttttatggaatgaaatggtgtttcatttgtgccgttatcaatcatcatctctattatactctttaggatatattaggctgcacttttatgcgcatgagctttttgtatttctcctcgtatttcaaagccagagttctctgaagacatgtcgaaacccatttacttatctccctgcctatactcactcaacacctggtgaatttccatctgccattcctttcactaaaacaatttaccccaagatcaccagtgacatacgtattgttgaatttagcaggcaattttcaatcctcacagcagtttccaacactggtgaccacaatctctttactgaaacaatctcttgctttggcttccaacttcccactttctccctccttcttttatttttctagtctctgtatcaactgggttgtgcgtgacctttaagtgaattccttaaagttcaaaccaaggctctcctctatctttattctacatcatcttctagaatgataaatgtgtgcccataactttctatttcctactgtactttgagcttcagacctatatgttcaattgtctggacatatccacttcgaactctcaaggtttcttctaaagctagtaatcctaaccaagttccatcttctccctctgtggcccacaaatagccataccgtgagagtgtgggtagtcatggttcacatgtatccaaaaagagagcacaggtaatggaagggaatttaggtgtcttgggagccatggtgtgatttcttgatgagagctgtggctcaggggtcactgtctgcgtgctgggcacagtgtgacagtagaatgcatggactcccaagctgaagatataagtgctgggttatctaggaagacttccttcagacactggtgtgatggtgctgtcattgacctgagtacctgctgcatggaaggggagaacatattcttgctaagactgggtatttgagatgtggcagtttatgaggtcagatggtaacgatttctggctctcagttgatttgctatatttttctgattcaattctgtttctctggttatatctgttatattcctgctctcccttacctgtttcctcacatctaaagaatacttcactcttcacttactcactggtattttccctgtaaacctctatgccttctcctgatctattgtttatctccttgtaagctaactcttctactctccaataccaggaagatgggagatgaagaagaaatattctctttttgctgaagcaaggatgcctcaattggagaacatagtgagagtgaatcacaacctaaaggcactaagaagtgagaaaggccggaacagacaccaaagttgacttccagtggtcccaggtgcctatcccatatgggaccccataggtcttcaacgcaatctactcagcctggctcagcccacagagaggttctgtgggagataaagatttctcaaaaaaccaaaatgagaaagaaaggctaggcctggaaagtgacccaaagctgagttaactgctctctcagcctccaggttacccatgaggatttctcctttctgtctgcatcagcctttgttctgtctttgcagactgcctttatctgcttctccagcatggaccacctggttctgctgctccagggcccccttcccaatttctggtggaaagaatctgactccacgtgcgcccattgatgggtgaacgttaaaactctttagaacacactttcttttccagaattcatgttgatgaacttgtaagaataattaaatcaattaaaattcaacaagcatcaagtatttggtaggttatcaggtacttgactgagtcaattcaggatttaatctcaacaggtaaaagcttaaaaaggaagcaatcatttgaattaatgtttgaaatgcagagccacaaatactaatttgggggttctggctaatatataacaccctcgaaaagtctgtttgtatttaaatatcacatggaggctctgtttcttgctccttgactctgcacgctgtagcatgaaagtgatgacattggactctctgtcttctctggcagaagcccactggaaaggatgtgagaaaccctgactagggacacactgagccttcccatattatttaatgacagtctgtgccagggcctccattaatttaactgaatgaaatattcctatctggggtttcaatagcccttcactgagtatctcctatacaatgtccccatcatggtgtagcctctcattgcaaacatacaatgaccccaagtgaaaaaattatttttataactatagcattttttttagagacagggtcttgctctgttccccaggctggagtacagtggcactatcatggttcattgcagccttgaactccaaggctcaagcaatcctccatcctcagcctcctgagtagctgggagtacagtcacacaccaccatgtctggatagttttttaatttttattttgtagagatagggtcttgctatgtttcccagactggtcttgagctctcaggctcaagcaatcttcctgccttagcctcttgggtagctgggactacaggcatgtgccaccacatccagctacaaaaattttcattattacctcagctggacaagcgagaaaactgaaatccagggaggttggagctgggtcagctaattagtgatggggccaggatccaaacccagatctctctgactcaaaagcttaaacactctacccaaccttcttgtgttcctggtttaccagactacccaccaggaacagactcgggacctactgggttaaggagaacttctaataaattcatctctttttacatgacttctctcccccttttcagcaaatttctggagtagaaacaatttacattcttctaagataattttcttccccctgaagattaccacacactccttcctgtgcacagacctgagggtgcaacgttctagctcctcaggaacttctgagagggtgaatcgcagatttggatcagggtgaaggctatgtttgatcaatgttgttccacaaggagatgcacagtaacatttagactacaaggaaaagcagctccagccctcttctttgtctgcaagttcagccacatgggctgtaatctcatagtttcaacagaggggcctgctgcctctggccttactgggcagcaggtggtggggacggctgttccttctggagcgacactgccatctcgcctgaagtcaggaggcaatggtgcaatgcactgctaatatttttctcctgaagactgatgacttgctggatctgtagctaaatgtcttgtctcattttcacagccacgtcatcgcccttttcctagtgcttgtgagtgagtcacgtgcaagggccatctgggaggaagcgttctgttaaacctttctttaaagcatctttttgatgtcctgggaaatgcacctgcccactagagttcaattcagcaaataattgttaaatgatcaccataggcaggggacttgctatgaatataacaaagatgaaaatgccagttgacagaagcatgacgtctcctagaggacccagatccaagtgaagcaagtgcagtccaaggcagggcagggtctaggctgacagtttacaaggctcagtttcttagccacttacctacttctgaaatgcattcttatatgtttaacatctttattgagcgataatttacataacgtaggattcacttattttaactgtatgattctctgattcttaacaagttcacagagttgtacaacaatcgcccttttagaactacccccaaaatatctctcatgcctatttgaagtcacttcccatccctgctttgaagtcccacccccagtcaacagcttctgtctactttctttatagatcggcttttcctcaaattaggatctgcttctggagaactcacaccaagacacggccccttgtccagtcttatgagctaccagtctgtcctgggacatggtggcagctgttgtctcttgcctttatcgtggtggtggctgtgctgacctggggaaccctggaacttctgctatcaatcccaacaggccagagctaggtggatgctctggtctcatctcattggatgagacccctgtcctgccctaacagtcaggacaagggtctaatccaatgaagaggggcatcaaagattgttcaagaacaatcagattgaccatgggaatgggtcagtggtgagcatgtaggatagtctctggggtagaagttagatgctaggcgcaggttaaggagcctggagctgatggtccaggagggttatgtcacctaacaaagcagagagtgtcagctcatctgcaaatggcgtttgcctttggggtaattccagcccacactgaatagcaggtccatgtgtaatctccaaagtcttcttcaactttatgagaatgggcctgggcatggtggcacatgcctgtaatcacagcactttaggagggcaaggtgggaggattgtttgaacccagagtttgagacctgcctgagcagcatggtgaaatcctgtctctacaaaaagtgaaaaaaattaggtaggtatggtggtggtgcacctgtagtctcagcaactggggaggctgaagcaagaggaacacttgagcccaggagattgaggctgcagtgtgctgtgatcatgccactgcactgcagcctgggtcacagagagagactatgtctcaaaaaaaaaaaaaaaaatgatggttgtattaacccaaggcctacttagaatctcaaagacctttctctctctcctcatctcctgccagagcttgaccactctgtggttctagctgcacttttatcacttctctgttctacttgcaagatggcttcttttcatttttttgtgaactttgggtctgtatgttgtcagcaatcttcagtgggcatttttgggcctcttggtcttcttgtggtctggtgagtagagatgttgactgatacaaggacagtggaattcccccattgcttcaataattttaatagctgaccctttgaggaacattgaagctggatggtcattcagacttgtcccaaattgagttgggctccagcaacacccattgaccagtcattggatgagtgatgtctttggggaggaggcgtctttggttgaggtcatagaaggactcagctctgaattctttgcaaacaacacactcagcagatgaggagatgtgtacttaggcccagaagtaggaatctggacagcagaccacagtttctactatagacaacaaaagccacacagtgaacatggagctaaaagtcactgtggttcatgaactataatatacctcacaatagcatgctataatatgtaaaaatacccctcggacagataagagaagaaggtggatagaaattcaggcttttggcccttttcaccacttcccaaccctcttccctttttctctcttctcttgtctcctgccagagcttgaccactctctggttctaactgcacttttattacttctctgtcccacttgaaagatggcttctttttattttgttatgacctttgggtctttatattgtcagttgctataaatgaataaaggctttttccttcttagtgtgttggtgaagaactaggagtattgcactcactgatcaggagggaacaggtctagggagtgcatagaagctttccaagaggagtggacaggaagcctgtcctccccctcgccctccacccccatcccgccccacctcctgcgaaggcaggaggaccatgaacctgcaatttggctgatggcagttaaggggtaatcaaaagtccaggcataggaactggttccttagtgtccatccaaagcctcaagaggctgacctggaaggatgcaggtgtgagaagccatgtgtggatcccaagtttaaggacatagatgttttccttacagaaatggaatttggacactatatggttacgtggtcagccagcaacagagttcaataataataaacccctaataaaatatttatgtttttccttatattacgtttctcctatgaaacacttattgattgattgattgattgattgattgattgattcattatactttaagttctgggatacatgtgcagaacgtgcagatttgttacataggtatacacatgctatggtggtttgctgcacccatcaacccatcatctacgttaggtatttctcctaatgttttccctcccctagcccctcacccccgataggccccggtgtgtgatgttcccctccccatgtccatgtgttctcattgttcaactgccacctgtgagtgagaatatgtggtgtttggttttctgttcttgtgttagtttactgagaatgatggtttccagcttcatccatgtccctgcaaaggacatgaactcatcgttttatatggctgcatagtattccatggtgtatatgtgccacattttctttatccagtctatcactgatgggcatttgggttggttccaagtatttgctattgtgaacagtgccgcaataaacatacggaaacactaatttcttagggtgatgaaactaatagaaacacagcccttgaatgtatttgtacatattgtagcattcacaattttttcagacctcataattgtcaaaatgaagggtggattttgagtacctctaggatttggaaataaattatgtgactttttacccaaggtcattcaaagacgcttgtgtagcaactctatatttgtattgcaagagctagactggaactttaaaatatcatcagatctctgtcaggtaaactcacagaaatgagcttattggtcaacacacttttttttgcatcttcagggtgccaggcactgggagaatcggggcaccacagatctgactccccacttggtggagctgacagtaaagcaatcacgtcaataatggcagcattctgcagcatatcaacagcaaagtagaatgcaccttggaaggccacagtggggacttaatctagcttgtgggccaggcaggaaagaagggccagcctcatagtgagaaggcttccagggatagtaaatcatgatgtgctgaaggatctgagaagagcccagcagggctgaggtgtagcaggcaggggtatcgcagtaaatccccagcaggaaacagatggcaggctcatcttagaaaacattgtgtttaggccaggtgcggtggctcatgtctgtaatcccaacactttgggaggccgaggcgggcagatcacaaggtcaggagatcgagaccatcctggctaacatggtgaaaccctgtctctactaaaatataaaaaaattagctaggcgtggtggcaggtgcctctagtcccagctattcgggaggctgaggcaggagaatggcatgaacccgggaggtggagcttgcagtgagccgagatggggccactgcactccagcctgggtgacagagcaagactccattaaaaaaaaaaagaaaagaaaagaaagaaaacattgtgtttaataaagggaccatttactatggtatgggctgagtgtcaggacaacaggctagatggtatagggctgtgtgatgatggacttgccaccatccttaggcctggaggggtcaaggggtcatggcgtaattcccagaacctggaaggggaaggaaactttggttgaccaatggaacaagctaagtaggttcattggggagtgagccaagggaatgagttactgagtttactcttctactgccttccagtctcctgtctggactcctgtggccctgaacacaccaaaagtcagagggcatggaatctcactgatgtcatgattactggtcagcctcatgagccagaaggcaggatggagggggaatgaacaaacagaaggaaccctcacaaaacagagagggggaaagagagatagacatacaagagagagctaggaaagttggcagtggccagattttaagagatacttggctcatattaagattaaggtttacttggaagtcactgggcagtcatctgtgtgatcagattattataagaagagaagtagcagactggagggtggatttgagaggagcaagggtggattctagaaggccatttgggaggtcatgacagctccctaggagttggggggaagtgagctaattcaagaatattagaagagtctcgttcagacagctgagtggacgtgcctttcactgatttaggaaacattagcattagaccaattatgggggtggggaaggagaaagcttaagtgcaggtgtgatcatggtcagcttgaaacacctctgaatacaattgggtggggtacaatgtagcagcgggaagttaagtctggagctcagtagatagtcctagatggaggggaatgttgacttatagatgggaatttagcaatggatatagtagaggtctctaaagagcacaggtagcatgaacagatacagaaggcctaggacagaatccataaaaatgtcaacatttcaggattgtgcagagacagatgactgagtaaagaagactgagaaggaacagataagtagtcgaaaaccaagtgggcagggcaggaggcaggttagggtgagttgcaaagtggctgagaaatgagaaaatgaaaccgtgggggctctcatcttctccaggaaggtgtgctgggaacggggaggggagataggggctagcaggcagagggtggtaggagcagagagagccctgctgggaaaggaggacttgagcctacctaaatgatgaccagagtcagtggagaggcaatggcaatggaaagaacaagggtccaggaggaacaggataatcatcagggaaaggttggaatgcggaaggcaaccaaagcatcctgcagagcgtgcattttgaatttctgtgatcctctggaaaaacaaccttctgtgcttcaatttaaaggaaggtgcatggactctgtgctcccctgattctgaaccacactccatcagcaaggccacatccacattcagagctccaggaagcctcccctatccctgtggacaggacttggggagtggccttgtactgcacaggtcactgtctccattctaacctaagtgagggaagagtggattggtccctggagtgtttacagacttggtgctgatggaggggtggtttaaaggatttttagctatttcccccctttctttattaagcagaagagaagactgggtcctgagagtaaagagtctgaggcttgagtaggttagagaaggagaaatggtcattttgtagagcaggagaggggatgctccttagagacactgaaggaccatttaggctggtgacggcaaatttattgtgacacaaatcttcccagctgtgggattttccccaacaacactcaacggtccagacacaggtataaaggtgttttttttttccccattcttcccttcctcttttccttcctgtctgatctatccaagttggagttcattacccacagattctatacataaatgccagtatattctatatatactaaagtctgtagattctagtaattcctaactcaccaaccaactacaaggtttaacaataatagaatcacacatatgtcacctttctaaatcattaacctgagagacgaaagagaagggggagtctgggggcccgagatcagtgactagagggtgttgcagcactaaaacatcacacgattgatcagacctatcatggctctttcactttcatgaacattttgtgttttgctttaacagaatttgagtcactcctataggtggctttagtggtccttccctgggtgttttctcagacttgtggtgggtaatggggtagcatatgtgtgctcacgtgacagagtggagttctcatcatttcactgccttcttggcaaacagaggcaatgagaacgtcaaaggcatcatttgcatttgtaaagcaaaagccagtgatcacatctgtatctaccatatggcagatgttccataattattttgaaaaacatatgagatttcagctgtgcagcacttattggagacttgaggaaagaaatttaggggcaagaaatttaggaatgagtattattttcctcttagaaactgacttctctgacttaccctaaatttagtacttccaaagagaataacagattttcatcattgtaaaatatcagcaaaaacagaccaaagtgctgccataaggaaaggaattctgttagtggtaccttgtctgtctagttgtgaggtgtggtcagctgcgtaatgctgtcacttccccaggatatccatgtctgtattagtctgctttctgttgcttgtaacagaattctagaaatgtgtaatttataaagaaaaggaatatggttcttactgttatggaggctaacaagtccaaggtcaaggggccacatctggtgaaggtcttcttgctggtgaggaccctttgcagagtcctgaggcagcccaggccatcacatggtgaagggctgagtgtgctgctgagatttctctctttctcctgttacgaagccacaaatgccactgctgtgataacccatgaatccatgaatggattaatcccattgtgagggctatgccctcatgaccaaatcacctttaaaggccccacctcttaatactgccacattggggattaagcttcaacattagtttcagagggagtaaacattgatatcataggcttttgcccctggcccccaaaactcatgtccttctcacatacaaatatatgcaatccatccccataaccccaaagtcttaacttatccccacaccaactcggaagtcgaaagtccacagtctcatctgtgagtctgtgaaatcaaaacgggttgtctactttcaaggtacctagaaagactcacagatttctattttcaaagtgataaataggcaaaaagaaaggcttaactagtcccaaccaagtctgaaacccagcagggcagacattaattgtaaagcttgagagtaatctcctttgactccaccttagcctccgagacactggggtgggagttgggcccccaaggcctcaagcagtcctgtccctgtggctttgcttggtgtagcccatgcagctacttctatgtgctgaagtctggtccctgaagctgtccaacgtgggcattgcatgctactggtgactccacagttttgggatcctggtggaggtcctgcctctatggctccattagatattaccctggtaaggactctgcagcagctctgaccctacagttacatacagcattgctctagtggaaactctttgtggtggcaaccccccctgtgacaagtccctgcctgggcccccaagcttttgatgacatccttagaaatctgggtggaggctgccaatcctctacaactcttgctttctgcaaacctgagaattagcaccacatgcatgctgccaagagcctgcagaattagcgctacatgtatactgacatgtgtattccttccagagctgtgccacaagccatacctagggtctcttgagcctaactagggcagttgtggagcaccgttctggagtgcaggaaacagagtcctctggtggccttgggcactgagcctatggagggtgcccttggtctagctcctgaaaccattctgccatcttaggcctctgggcctgtgatgagagaggcagcctcaagatctttaaaatgccttcaggatctcttttttctgctatcttgaggaaaagcacctggctcccttctattcatactaatatgtttagcaaatggtctctgagctacacccttgattttctctcctgaacacacttattaacttttcacttggccaagatgagagcttttcaaatctttctgttctgtttctcttttaattataaattatgtttttaaattattcctttggtcccaaatatcagcataagcagccaaaagtaaccatgtagctccttttatattttccttagaaatgccttgtgtcagaccaaggcagggggatcacaaggtcaggagttcgagaccagcctggccaacatggtgaaaccctgtctctactaaagacacaaaaaattatccaggtgtaggggtgggcacctgtaatcccagctacttgggaggctgaggcaggagaatcacttgaaatctgaaggcggaggttgcagtgagccaagatcaagccactgcactccagcctgggtgaaagaaactccatctaaaaaaaaaaaaggagaagaaagaaagaaagaggagtttgagaccagcctgaccaacatagtgaaaccccgtctccattaaaaatacaaaaattagttgggcgtggtggtgtgtgcctgtaatccaagctactcaggaggctgaggcaggagaatcacttgaatctgggaggcagaggttgcagtgagccgagattgtgccactgtactccagcctaggcaacagagtgagactccgtttaaaaaaaaaaaaaaaaaaagaaagtaagaaagaagaaagaagaaatgccttgtgtcagatatcctagttcatcattcttaagtttggccttccataaagcccttgggcagggacacgcttcaaccaaattatttgccaatttataggaagaatggcctttactcaaaatttcaataccttgtttttcagttctatctgagatctcatcagaatggcctttactggccatatctctattagcattctggtcaccaccatttaaccaattcctaaggagttacaaacttcccttagttttcttgccttctaagccctcaccagaatccaggctttttctagcctgctccctcagcttccatcctctgcccattacccagttccaaagccacttccacattttcaggtgttcactatcatcaacaccccactcctggtaccaattttctgtcttagttcgtattgcttataacagaatgcctgaaactgggtaatttataaagaaaagtaatttatttcttacagttatggaggttgagaagtccaaggtcaaggggctgcattttgttgaaaggtccttttgctagtgagggactctgtaaagtcctgaggtggtgcagggaatcatatggtgaggatgcttagttattgttcaagtctccgtttttcctcttataaagccactaatgtcactcctgtgataatctattaatccactgactcgttaatctattaatcaataaatggattacctcttaaaagtccacatttcaatattgccacattggggattaagtttcaacatgagtttcagaggggacaaacattcaaaccaaagcagtgtactgtctccaaaacctgtaaatgctaccttatatggctaaaggaattttgcagatgtatttaaatttaggctcttgagattagaagattattttggattaactattaagcctaatgtaatcacaagaatctttaaaagagaaaggcaggagatcagaaggatagtaaaagatgtgatgatggaataagaggttggaatgatgtgtctctcataagccaaggaattcaagaggtctttacaagctgaaaaagactttatgaggtggaaaagctttacaagctgaaaaagggaaatcagatattccccatgttccttcaaagggagtgcagcccagtttatatcttgagtttagttctgtgaaattgaacttggacttctgtcctccagaattgtaagagaataaatctgcattgtttaaagccaccaaacttggggtaatttgttatagtggcaataagaatctaatactgtagaataatttactttgagttttttttctctgagtttcaccaatcagctattccaatgtatattcattattgattttcctgcatagggaaggtaatgtcagcaataaatttgagttaatgtgttagctctcaatttacctattggcaatatagattcaaattagagaggaagcatcacctaccccaaagccccagcaatctagttcttttaactcatttcactcccagagtaaaacaggtattttggtaagggaatcactgatgttacttacaaacacaggctctcaattaaaaaaataaaattttctttttggtccaagctttctctttacacacctcaataccatcctttgcctacaaacttaactgtggatatctaaaaatgtctttatagggtaataacatttttccaaaagtcagtagcttaattttagaagtaaaacattttaatggcttaggctatagttttatagcattgggaatggaattttcctgtttttatggtaaatttgtttatctaaattgttctaattttaatctctttaattttgtatgacctttattttatttttaattgaagagcaatatatactgaatgggtgaagtttgtaaaacacttgaaacacacaaaaaagcaactcttgtagttctacaatgtagagagatactgctaacagtctggtatgtcttttattaaacatttacaattaggtgattgttttattctttttttactgcttcatgaacattttcttcacatcagtagacgttcttccatattacacttataatgacaacatcctagtttatcgtatgtatctgctactattagctgatcctctactgtagattcaggtcattcctgaaatattattattgccaattcatgtgctttgctcatttcttttttggtgtgttatttgaaaaataggtttgcaagcttttataaatgctaggcttattaatttttaaaaggtatgtataatcttcaaaggtcattatttgccttttaattttgtttatggtgagctttattgatatataagcattaataaatttcatgcaatcgaaactacttggcattttcatttagggtgtgtctgtgatgatttgtattctctttttttttacagataggttttcttttgtcttgatggtatactggattttaactcttttcttcttttagatcaaatgcatatttccttcttcgtggtggagcagtggtgtttttagtccttaactaaccacttagcttattctgtattaagaacattttttcccacttagtatatttttgaccctaaatctgctggctaacttgatagtctgattcatcttaaagcggctccaggctgaattcaattacaaacataaggatagtattactatcttctgtaaatatgcacatacttacattgtgagttaaatacctaaaaaaagtaatgtgcatctaatgaaggatctttttttttttgtcccagatgacaagataaaattcttagtacatggtttccatttttcatattttggtaatgtccccactattaacaacataaactgataaattagaaaacaccagatccttacaactgtattaaatttgaagaaaaaaatgatttctttctatcaaggtagagaaaaaagaagctgaataagctctgggtttctggaatgtctccattcagctctttctctgcttatgttccaaacaattgcataaaagcaatcccaaacaaatgtttatagggctgcactccgaaataaagataatgaattctacataacaagtacactctttcccctggctgtttgcatttaaaatgtacattttgcagtaattttgatgacttcattttgaagcagttcttaacagacattttggaaatgtctcatgtcatgaatttattcataaaccagcctgtcaaaaaccttagtgttcactggggagaatgtgtctcaaatgcacaagtggttgttccacctacatcatccaccatcttgaaatatcattattcatttccattacttcttggatgttctggttcactgctactgggtttcgcaacagtgtggagaagagaccatgacattgaattaccggctaagcagcatccataagtgttatattcctcccttaattatgatgagaacttgtgtttaggaagctgtgatgtttactgatatggttaatggtcaatgtcactcatcaaaagggtgataagacaataatgggatcttggaacagggaagtcaagataagcacaatgtgtcattttttcccctacaagcatacagtccttaatgaagacaaataggccctaatgtttatttgttcaatgaacatgctattggattgtgaacaagaggtcagcgtgactagcaatgaggtgtaagctgctctatcaaagggtgatatttagtgactagagcaagtcctagaatgttttacagtaaaccattgtagttacaacacattgtttctacccctctgatctccaagagacaaggaaaataagtggatactcttgtctttccaatctggaaaatagaattggaagtggatgctttttttcatttctaattcatagctctttgatcttgattattcatgaagcatatgcgtccatgaccatgtgttaaatcagcacttatcatattttattgtgacattcattcctgggaattttattaaaatgcagattcttgggtgggagctgagattctgcatttctaaccagctgtcaagtattactcatactgtttctggtccatggaccatactttgagtagctgactgattccaacttgcaagacagagacagcagaacctgcctacatagatttagaaccttgtctcataatagtgcatgtatgcttagtgaggcagcatagtaacatggataaaagtgcaggctctgggtgtgaattctaccactacttttgctaagctttgtgtagtgccagtcacccctatagtctctgtgatcaatgacaacaaagatttattttgtgctcacattacgtgttggactgactgttggccacaagtgtgcaaattctgggaaccactttaaagacagccttctctgggacatgccattttaccctcatcttttgggaacctacaatgactaaaacttctgctcggatttgccgatgtcatgtccactcacatgctattggcctgagtcaggaacatggccaagcctgatgtcaatgaagcagggaagtagactccttctgcacacagcgtgtatagacatatggcctcctgcaggaaagggagtgaagagttgggacaagaacacacttttccattgtgacttagtagctatgtactcttgttattttcacaggattgttttgaggattgaataagctaaaatggatagtacattgtacctacatgacacttaggagaagctcaataaatgcctgtaattataattgcttttgtttttgttctcatacttcaccctagtcctcactgcacagttgctgtacccttgaggttgagaaaagtccctctccctgcctttcatgatacatgaaacatactgaggcccactaaataccaaacaatcagatcatctgaggcatctgcagttaaagaaaactggattactacacaatcagttatttccaaataattttagacaacgattgacttcttcctggccatcatattttctgagtttttgacttgagtttcagatcactagatttcccctgattattctctgaatttgttttatggcctgttcttgggtcgtttgttctacagatgtgtactgagcatccagtgaaagtcagctgttgtgtgaggagcaaagattcatataaagtgtggttactatttaatgaaagtttgtgagtacactcttcatagacgccctcattcactgttatctaattgccaggcagtgctggatgagggtgcaaaggtgaaatccagcctaaataaataggagtctggggagcttgagcatatttagttagccaaggggaatcactatagcttgtgaacagtccaggaatatgaccttggatttcgaaaaaaaaaaaattgtgggtagtatatgtaagttgttggagcctctgccattgggcacttggtggagtgagattatagggctgtgagccagagcatggtgtagtgaatgggatagatgtgtttgtgtgagaggaaaatatccagtggctgcatagctctgaagattatcagtccaggcaattgtggacaggcaataagtttatgtgatggaggaggtagtgcattcaactggggccgagagtttgcgttgtgaatagtataacaagacacagatgttggaaaaaggggttcaaataatttgcagaccagctatccaggtcaactagctgatgatccatgacacagtgcatgttaaaggcctatcaatcttattgtgtagaaggagtatagaccaagggatacgtagtcattaaatgctgaaggttgagatccttgttgatgcaattgttcactttactaagaggtactttttttttttcaatttgactaagaacaggcctgaagattatcagtccaggcaattttggacaggcaataagtttatgtgatggaggaggtaatgcattcaactggagccgagagattgtgttgtgaatagtataacaagacagagatattggaaaaaggggttcaaataatttgcagaccagctatccaggtcaactagttgatgatccatgacacagtgcatgttaaaggcctatcaatcttattgtgtagaaggagtatagaccaagggataagtagtcattaaatgctgaaggttgagatccttgttgatgcaatggttcactttactaagaggtacttttttttttttttttccaatttgactaagaacaggcgtgctttactcataacacacttgtttttggtgcagtatatcgcaaaacaaagttgctgtgttaagtttaactgtgatttaaactgatgttgcctgagtccccaaagaccaatgaaacacaagtgggatggaaaaagcagccacttctattgttgccaaatgatagaaaagatttgaaaaatcaaatgcatcaggttagcctcactgtgcagcaaggaaaaaaatgaattaattataaataagatgaataaataatttaaatatatcacttattgcttctttattgcttaacacttgaaaaattgtttcaattagaaacttaaactcaatttgatagacgaagagtgtgcagctcaagataaatgtaaatccctttgcgatataaaaatttgattttgcagtatgagctctattaaaaagaaattaataatctctagaaaaagaaggcagtgccaaggaaggttggccttttcccacagaacattgctttttaagaggaaaaatcagtaagcttattatagagaaaattttttaaaaaatcagaaacgcaaaatactaaccaccaaccccacaaacaacaaaactaataagcatttgtctctctggatttcatattaaaaccgtagagtaggtttttgtgcttcttatatttcacatgattttttgtctaagccagacaaaatgcttcattctctctttgagtttgttgggcctataaaaaatggtagaacagtccaggcatcgtggctcatgcctgtaatcccagcactttgggaggccgaggcaggtgaatcacctgaggtcaggagattgagaccagcggggtcaacatggtggaaccccgtctctactaaaaatacgaaaattagccagccatggtggcgtgcgtctgtagtcccagctacccgggaggctgaggcagaagaatcattggaacccaagaggcagaggcttcagtgagccgagatcacaccactgcactctagcctggggacagagtgagaccccgtctcaaaaaataataataataaaataaaacaccagaacaatttcatattttttgtacctaaaaagcaagggatttatgtatctgaagtcacaatggaccttacccaagacaagagtatcctggaaagttgctttgattcctgtgccatcatgttctaatgctgcaaaccctctctccgcattcttggcagatatggccaattaatgagatcatgatcttttgtatgtccagtctaaacctcagaatccctcccatcacaggcctccagccagccacttcttggcacgtggtatgaaacctactgcccatctgtcccagcagctgaaggactaagagttcaataacattttatctggcacatgaacaatttgcctgatttcttaactacgtgcaaacatctatcaccttatgttttagttcagtctgcagaaatgagttctttctattatgtatagaaaaaaagcaaatgtctcaggaaattatgtggcctatgtattttaccttttggacctaaatatacatctaagaactaaatatggcctgagaatcagctcccctcctccccagaatctcataacaaactgaacactcatcatccatcaaaaagcaaacacaaaataagaaaacaccagctgggccacaaatgccagtccaggcagctttcaattaacattcagagctgtcagaaactctacagcaggggtagaaaacggatggtctcagcccacagatgtcttgcttggccagaaggagttttatttctttattctggccctatgtgggtcccctcctctccaggtatcataggcttccatactgccccattctctttatcccagtgacatctgaagacccctgactttgtgattcctgatggcagaattctgtctttcctcattctcagtcacatatccgtttatctctcttttatggactgaatcatgttcctccagaattcatatgctgaagctgtaaactcctaatgtcactgtatttggagataggatctttaaagaggtgtctaagttaaaatggggatattggggtggcccctaattccatgtaagactggtatttaagaagaggagatggccgggcacggtggctcatgcctgtaattccgaggcaggtggatcacctgaggttaggagttcaagatcagcctggccaacatggtgaaaccccatctctactaaaaatacaaaaaattagccaggcgtggtggcgcatgcctatagtcccacgtactcaggaggctgaggcaggagaattgcttgaacccaggaagttgaggttgcagtgagccaagatggcgccactgcactccagcccgggcaacagtgagactctgtctcaaaaaaaaaaaaaaaaaaaaagaagaagaagaagagattaggacaccgggacacaaagagggatggccatgtgaagacgtgcggaggaagacgaccatatataaacctcaggaaaaaacctacctccaaacaccatgatctctaacttctagcctccagaactgtgagaagcaaatttctgttgctaagatccagagtctgtggtctttcactatggcagcccagaccaactaagacaccatctctagtcctgaaatcgtgaggaagcagcactccccaagtcaatctacattcagtgagctgtggggaaatggactgcagtgctgagcttcacggcctgagtccctaaggttgggatgaagacaatgtgaggagagtcactttgatttatagctccaacaattatgaagcctcttaggaatagggcaagaaagcattttactgtgtctcgactccaagaactataatgacatcttttaaaatttcattattctttttgtttttttgagacggtgtctctctctgtcgcccaggctggagtgcagtggcgcaatctcggctcactgcaagctccacctcctgggttcacgccattcccgcctcagcctcccgagtagctgggactacaggcgcccgccagcacgcccggctaatttttttgtatttttagtacagacggggtttcaccgtgttagccaggatggtctcgatctcctgacctcgtgatccgcccgcctcagcctcccaaagtgctgggattacaggcgtgaaccactgcgcctggccttaaaatttcattattctatttacaatataaatagcaatactaagccaacgtaagcggatattgtcagtgttgcacgctttattagagcttcttggaagatagacataaacacaacctgccatccagccgtgtccacgtgatggcttggagaggcttttgcttcagcagccagtcagtactaagcatatttctttttcttttctttttttttttttgagatgaagtctcgctttgttgcccagtctggagtacctctgcctcctgggttcaagcgattctcctgccttagcctcctgagtagctgagattacaggcaggtgccaccttgcccggctaattttttttatttttatttttagtagagatggggttttaccatgttggccagggtggtcttaaactcctgacctcaggtgaaccacccacctcagcttcccaaagtgctgggattacaggcatgagccactgcacctggccgattgaatgtatttttctatgaagaccttttccctgttttatgaagcatcaactgtgcattctgggtggaataacaaatctgagtggaatacttactatttacttgttatgtgcttcctagaacatgttacaaattcttatttattttttgtgctgtatgctatagcatcccaaacatctgtgatgctgtgttacactagagacaacattctcaggcttgcatgcacactcacatacacatgtgcacacacaccctcataacacacaattactccctccacaagtcaatcaaccaatcatttatacaacttcatcccatagagtgttctttaaatttcaagcccatgaaggatggtgaattctcaaagcaatttcattgcagagggcaaaacgagctgtcagaactagtataggttctattaagggtaagataaagtaaactctaatcagggccagtaagaaaaagctaactacgagaagcttgagaaagataaacgtttgcctggccaacacggcgaaaccccgtctctactaaaaatacaaaaattagctgggtgtgacggagcacacctgtaatcccagctactcgaggggctgaggtaggagaattgcttgaacccgggaggtggaggttgcagtgagccgagattgcgccactgcactccagcctgggagacagagcgagactccatctaaaaaaaaaaaaaaaaaaaagaaagaaagaaaaacgtttgcatcctagggggctatttaaccaaaaggtgtatggctcctgtgagctccagatagtggcttgtgaacctctgatattagaaaggataagaaatcatccgtttctgtactgagcctcaaagagaagactcagccctagttaggaaatacaaacaagacctatttccgctaaattggcaaagccaccaatcagagccatatagactttgtgtggtcaagcttcccaccactgatttcatgactcctaacggtagaattctgtcctgtgaggctgagaatgaacatctaactttaagaaatacagcagaggccgggcacggtggctcacgcctgtaatcccagcactttgggaggccgaggcaggcggatcacgaggtcaggagatcgagaccatcctggctaacacggtgaaaccccgtctctactaaaagtacaaaaaattagctgggcggggtggtgggcacctgtagtcccagctactggggaggctgaggcaggagaatggcgtgaacccgggaggcggagcttgcagtgagccaacatggtgccactgcactccagcctgggcaacagtgcaagactccatctcaaaaaaaaaaaaaaaaaaaatcaatctactccttgcatcatgtgtgacattttaattacctaggcagcttatcaggacataatgaagcagctgctatgattatagaattttgtcccaattatttacaaagctgctcagctacagaaatgtctcattgtcatatccagcatgcttaggttctagagcaggtgttaagcctgatttactggccaaatcagaaaattattccatggccgtcactttttctttggagccaaaagattaaaatttaagttattctctgaaagtgtgattttttttttttttaatcttgattgtcttcttccggctatcagctatctttcctcgtcgtcctgaaggtcttaatgtttccctggtttcattctctgtcttcttggtgttatcaaactctgctctatcggcacccttccaacaggtgagtatgcaatattctgattctcccaaaggataagatgaagcgtttgtagcaaaatgcttttcacagacccctagtaatacttttttccaagcataatgaataccgactatgcgccaggcaatgagataaaaatactcatatttttttctagtaggaattctaaaattagattctgattgctaagcagaaaacagttcttttaaggctacctctaaattgtggtgctatatggttgctgaaatccataaaacagtataaaaaggtcaactgttaaattaatctttgtgattgattattgctgtccttgcaataatctggtttaagttagaagttgcattgtggctttagttttaaatcgtcacagaatcccttccatatgcttttacagaaaagagagtatgatattttaaaagaagttcacatggaacattctctagggaggtagacatattgtgtgggcctaaatggatgaatttacaggatgctggaacttggagaaagtggtcaaaagtagctatcactgcaagttacctaacattactaccttgaggccggggaagttggagataagaatgagtgcttccaaataaaaagcagatggaagaaagggacctatatggataagagatgaatgagtttctactgaggaggccatgcttatgttcccattgtgactgggatggctgagatacagtacttcctctagtgaaggtataaaacaaaagttatttttctcattaaaaaaaagttacactttaacacaaaggggaaccaaatttacttacaaacaaaacaagtaaggatagacagggtcacacccccatggcctgaatttgcataatgttgtccttttagattaagaagaaatgtgtgctgatgaattgttcatttttattcagagcacagaaatctagtttcagaaaagaagtgtaggtctacttgagtcataatgttttcttattgaataacatgcattcatttcagaactaaatgcatttagtttattgggaataatgaagtaattcttggaagagggcgaggaaagtggacagcatgttttattctggtgttgatttgcttggatgttccacagacagtccaagctttttgtaggtcagagaaacatccttaacctggggcaaactttgacacccagcagatgccttcaatcctctttatctatcatagtgtctgtttttctgtggtctcttttactacttcaggtttgctattaatgattatttgaactcatttcctcagtatacaattgggggaggagtggagaagattaatgtcatagtgtcattttttccctgtattttgtgggtctgacctcgaattctgatccttatactctcttaagtttatacatggatagaatgttgtatcagaatgtacttataatggttgcctttactaagagtatattaattatgggttgagcttataattaattgacttcatgattgtaaaagtgaagggcctggtattacaccgaactgcttcttagcacaaagtaggaactcaatatatatgagtggaatggatgaataaaagtgagtataaataaaccatgactgctaagatgaaccactgttcaattgtaaacaatgcaagataacccaatcgttttgacattatgagggacgtgcatcttttcttgagaaatggggtgagacattaagtcaggggcctgatatgaggaagtggtagattcatttgtaccagctgtttagtgacaatgagaagagattacagaagtccagtgtgtctagactaggccacatgtgatttttatcttaaatctgatagtggcatgccagttaggacacatcattcggcaagatgtaattgatatctcaggtctgggaaaaaaccttaaattgttttgtgctcttctgagtggctagtatgcaagcccgcacatttaagattgacatcacttttgagggtgtttctgcccctgagtagggacctgccacatggtggcaaatgtgtttctgtgaaatactttcccagcctgtatttcatggactagtcctaggtggtctttgcaaaatagaaaaaagctgtgtccatgttcaatgattcaatgtatttagaaaattgccatacgtttcaaatcgagcccttgggctttggaatcaggcagggctgggttcccagttggcaagtttgcaaactgtgtcatcctgggaaagtaacttagcctctctgagtttcagattcgtaatatgaaaaataagaataataacaccaaattttggggactgactgatgattaaacaggattccatatccatatcatatttaagcaattttagtggtagcctatagtaactaaactataaatattagtgattacgaccattattatgattagtattggtttctttctcttgggtatttaaaatagacataaggaactctgacgaatcccaaggtgaagaagtcactgacttgccttaaccagcagtttctcactctatttgaccaaaggtctggctttttcacttagcatgaagatgccatgtcccctgcagcaccttttgagaaaacatctaagtgcactacttctcaaaattcagtgtcccttcaagtctcctgggtgtctcgttaaactgaagattctgattgattaggtccaggtgggctcaagactgtttctaaaaagctcccgtgtgctgctgatgctgctggttcgtggacctcattataggtagcaaggactgggagcccgtgactatggtacctgcatgtctgaagtttatatgtggatgatttctttctttctctttcttcctttcttcctttctttctccctctttctttcttccttccttccttcctttttttctttctttccttccttccttccttctttctttgttttgttttgagactgagtttcgctcttgttgcccaggctggagtacaatggcacgatctcagctcaccacaacctccgcctcccaggttcaagcaattctcctgcctcagcctcccaagtagctgggattacaggtgcccaccaccatgcctggctaattttgtatttttggtagagacagggtttctccatgttggtcaggctggcctggaactcctgacctcaggtgatctgcccacctcggcctcccaaagtgctgggattacaggcatgagccactgtgtccggccagatgatttcttttagatgagataattgcatatcagcattagggaaaaaataccatctcaatggaaaatgatgatgggagtatgtggaaaggaaagaaactagtagtctaccattttatgtgggtctgtctctacccttctggactgtaaattctctgaggaggcagatgtgttggtttcctcactgctctatcccaatgcccatggcttttcttggcatagcatagacagatacatacatattaaatgactgaatgaatgaataaatgaatgaatgaacgacaggacaccgagtcttttcatcctgggagtcccattacatgccacatcccagaggttggcgggaagccatactgtggtaactgaaagatatgtacaagattaggatttaggcagcatacgaaagccttacttttatgctttatttattgaaagtactctctattttttgttaaaagtctgtactgctattctcctgataagtgtattggccagtgaggccttcctgcccttattttaggaaacttcaggagcaccttttccatggtgggaccacaaaggcagttttccatcagagtaattccacagtgagctcaaggaagggtacaaggatggattgaataatttctcttacagctcctgaagctctctacaagggagtattttcttattagtgttatcacagctcctggaggataatagacaatcaactgaggaggtcctcaaatgagatttctcacagatttgctcatcagtgtggtgcaggttcatagctttaaatctcaccaaagatagtttatgtttgtggctcaatgcaaattgttttgcccacatctaaatttatttccattttatttgtattggtctctacttctaaaaagcttttagtgcagaatcatcgagttgacttggaagttatctttctgtgcatttagactttatgaattagaagactaaatggtatattttaaatggatataaaaaatcaaatgaataaaataggccataattcagctttgtttagaatgaatattgtctcagttcacttgggctactataacagaatgtcacacctgtgtgcttctcaaaaaccaacattctccccccacagtactggaggctgaaagtctaacattaaagcagcagaaggttcggcatctggttagggcctgcttcctggttcgtagatggtcatctcctccctgtattttctcacagtggaaaggaaacaagagcactctctggagtcaattctatcagggtactaatcccattcctgagggcttccatgaattaatcacctcccaaaggctccatctctgaataacatcacattgggggttaggatatcaacaatgaactttggggaggcacagatattcggcccattgcaaatatatttgtgcaaaggagattctaataaatgttgacttgtttctgtatgttaatccaaagcacgttgtattagtccgttttcacactgctgataaagacatacctgagactgggtagtttataagaaaaaagaggtttaatagactcatagttccatgtggctggggaggcctcacaatcatggtggaaggtgaaaggcacgccttacacggcagcagacaagaaagaatcagagcctagcgaaaggggtaaccccttataaaaccatgagatcttgtaagacttattcaccaccatgagaacagtataggggaaaccgcccccatgattcaattacctcccactgggtttctcccataacacatggggattattacaattcaaggtgagatttgggtggggacacagagcagaaccatatcacatgtttttgtatattctctaataaaatgaataataaatagttataaatatataaaaatatttatatatttttgtatatatttataaataaaataataaaagatgagttattttataaatttgttttaaaagaaaattttcttttaaaatattttcttttctccaaaaatattgcatacctattagattatatacagaagcaaatttgacctttccaattttttaaaggtctgtatgtgaagaaagagaagaatgcgattttttaggctactttgagctatgctccccagagttctttaggaagcaatggattcttcaaattgggcatccttaaagcatcacagtcatttgccttcaacaatgcagtgctcatggacatatgaaagacattttaatgcagttttacatgtgacaagttgaaagcgtcttccaagagttccaccacactggtgctgtccactccattgctcgggattctttgcagtgatttttgagaggtgtgggccttttcctctttatgtgtcacgtgactccacagatgcctttcctgtgtcacccgcagcagatattactttcccaattaaagtccttttaaagaatggcttttctccaaaagtggaactgaggccttttagtggtttcttgctatttttgacacacatacatgtatgcatgcacacacacacacgcacacacacgtacacacacatgcagatagtagcaggtttaaagctacacattccacatcaatttctccccatccctggcttccaagtgcacggtttggtattgctgtctgtgttacacaggttattgctgcaatcccatgtgccggtgctggtcaacactgaagagctgtgcccgcacctcatctattgtaaatcagtgccagccttagggtaaattaccttcctggagtgagaactgtaacctgctaatgctgctatgtaacagtctcagcaatgtctgactccttcttcggaatgttgttattgaattaggtgttatccaatgtccacttttacactctcccttctctcttttctgtaaagaatttggttgcattgtttgtctcaaggatgaagaaaaataccaataaataccaccagcaacctcccctggcaggttcaggacataagctccataatctgaatttccctcctatgtttcatgaaggtagatgatgtaatccctatgtgatccgcctcagggcagtcatgttaaagtgtgacccacctgaattctcaactaaaatttaccatacaaaaataagtggaaggtcacttgcattacggagaagcaattcttaatatgacacttatttatttaataagtacagactgaatcccagctatgtacaaagcagaaagtgatttttttttatttattttatatttatttattttttagacagggtctcactctatggaccaggctggagtgcagtggtgtgatcatgcctccctgcaacctcaacctcctgtactcaaatgatccttccacttcagcttcccgagtagctgagtctacaggtgcatgccaccatgccctggctaattttttgcattctttgtagagatgggacttcaccgcattgcccagactagtctcaaacttctgggctcaagcgatcctcccgcctcggcctcccaacatgctgggatttcaggcttgagccactgcgcccaaccaggaggtaattttaaaactcacaagccacacttcctttctgtgagaagtttgtaatttaggatgaaaactaagatgcttaggctaataattaaaatgaaagcccattaccgattcaaagtaaaatagaagttaagaaaggcagaggccacttatggtcagttggttaggaaatagttgctggacgtgataccattggagttgggcttggagagtggggcttaatttctggcaggactagaagagaaggtttttttttttgttgttttttgtttttgagatggagtctcgctctgtcgcccaggctggagtgcagtggcgtgatctcggctcactgcaagctccgcctcccgggttcacgccattctcctgcctcagcctcccgagtagttggtactgcaggcgcccgccattgcgcctggctaattttttttttcttttttttttttttttttgtatttttagtagagatggggtttcatcgtgttagccaggatggtctcgatctcttgacctcgtgatccgcccacctcggcctcccaaagtgctgggattacaggcgtgagccaccgcgcccagccaagagaaggtatttaaagtagaggaaaatgggaagaagatgcagtagcttgaccatttaatgatgaaacctagtgcagtttggctacagaatgtaagtaggacatagctgaggtctgttgagaagcaataatggcctgggttggggtggtttctatggaaatgcaaagaaaagttaattagctcacagcgtgagcttagtacattcatctctctgtatgtgtgggggattggtttcgggacccccaagtataccaaaatccaggcatactcaagttcagaagtcagccctatataacctgcatataaaaaaaggttgtatacttcagttttccatccctcaaatactgcattatcaagctacgtgtggttgaaaacaaatctgtgtctaagtggacttgtgtacttgaaatccgcattgttcagagagtcaattgtatgtacattggaagagtgattgcagtaatgaatgctatttactaatctgatgttctgccgttctatatgctggaaagtaaacacatgataaaatttaaaatgtacaaaatgggccaggcacggtggctcatgcttgtaatcccagcacttggggaggccaaggtgggcagatcacttgaggccaggagtttgagaccagcctggccaacatggtgaaaccccatctctactatttttagtagagatgttaaaaaattacccgggcatggtggcacgctcctgtaatcccagctactctggaggctgaggtgggagaattgcttgaaccccggaggtggaggttacagtgagccaagattgtgccactgcactccagcctgggtgacagggtgggactccgtctcaagaaaaaaaaaaatgttactattaataattcaagagatacatgttaaacatcttgttttgattttgtggaatttaactacatcaatcgcctgaaatatggccacagaaatattctagtattataccatatttagtgtacataaacaattcaagtactagtctgctagggtcccataacaaagtacttcagactagtggcttcaacaacagaaatttattttctcacaaacctggaagctggatttctgagaccaaggtgtcagcgaagctggactctcctgaggccattctctgtgtgtctttataggcccacccctctacatgttcctgcatcctcatctcttctttttgtaaggacaccagtcagattggaacaggacccacccatatgacttcgttttaccttaaatacccctttaaagaccctatctccaaacacagtcacattctgagcaactggggattagaaattcaacacatgaattttgtggggacacatttcagccggtaacactccacacacttgacttttcaagtttcttataatatttttagttcataaataggataacaggagatatatatatatatatatatatatacacacacacacacacacacacacacgtttatatttggaaataggtgaggcacaaaattataaatggtaagtaaaatactgaaacccaagtcacctttacaaagtttaggtggccaagaggttgcatgtcagtttctagagcctcatcatgccagtatgcaggtgggtggtcccttagcttctgatagaaagaacatgggctctggaactttgtttggaaagaacacgtgcttcagcacaacttgcatttaaggccagattctgctatttacaagcagtgtgacttgtctggctctgcttccttgacattcaaatggagacgatgacatctacatctgcgattgttataattgagaagatgcatgtagaaagccctaggctcctaactctgcttgtaaaggtgagattcctacatggtgtgaatgaggacacacttctgaatttgatctgtacatcaggtgtctgttttttccttcccatggatatagctgtatatataaatcttagttgtcttttttaaagaaaacccaagctccttaccatctggtctctgcacaccttccttaccccacccagccctctgctcactatgcagtggccacatgggcatttttctattccttggtgatacccaggtaattccacttcaggctctttacactgccatccctttgccaggcccggctgtccctccaggtcactcaagtcctggctaagggtccttcacttactatgtattctgaagtcacctcccatcaactcacctattttattttcctcttaactttttatcatataaaattatttattgatttgctttttataccatttgtcttcctcacctttccccactggaatggcagatccatgaggacagcagcttcgcctctcttattccctattgtaaactggaatagtgcctgaatttgatacgcatgcaatgagtacttttacaagaaaatgttataaatgtgtaacagcattgaagggtataaacttccttcagataaatttggcaatacatattaaaaattaatactgacgtctgaaccaaaatttctcttcgtcagaatccattccatgaaatgattgaggaagtttttaaaaagtttaagtgtgtttatcatcagtcagtcaggctatggtaataacatcctaatagcccgtcttgcctctctctactctccttctttcatacttcagcccaaaatacctttcattcccatttttaaaaatacaccaaaatgatcaaggttaaaaagtcaaaagtctaatatagtagaaaacaatagttagctattccatcttttctgagcccttccatgggcaggattattcaaacacaagtttagtctactcacactctttttttttttttttttttttttttttctgtttttgagatggagtttcgctcttgttgcccaggctggagtgcaatggcacgatgtcagctcaccgcaacctctgcctcccgaattcaagtgattctcctgcctcagcctaccgagtagctgggattacaggcatgcaccatcatgcctggataattttgcatttttagtagagatgggttttctccattttggtcaggttggtctcaaacccccgacctcagatgatccaccctccttggcctcccaaagtgctgggattacaggcatgagccaccatgcccggcccacattctttatgatttttgatatactgaacttcttttcacaccttacttttgacttctatttgtcacactttatcatccttatacatccttctttctttgtttaataagtttttcttttttacttttactgtacttacttagaatgtatatattctatttccatttatttagatgttaccttggaaatttaccatgtacatttaaattagcaaaagtctgcaattaagcaataacctaagcaccttcttccatgaaaagcaaacaaaaaacaaaagcaggttttggagcattttgattctgaacactcacctcaaaacctacatgcttctgggccaggcacggtggctgggtgacagagcaggactccgtctcaaaaacaaagaaacaatcaaacaaaacttacatgctcctgttgttttctctacttctatatatttatttttttttaacccagatactaggtattattttattattagcttattcagatgttatttctttggatttgcttactgttttataatttcatttgttcattcttacttggatcccaaaccatctttttaaggtcgtgttcctttttcttgaagcatatcctttagaattttctttatttcaggtttctttgtggcataccctctcagtttttgttatctttacccatccttgttttatctttttcataaaagagtatttggctgggcacacaattctgtactgactatatattttccctttgtactttggaggtaaaatatcattatcttctagctttcattagtgctgttggaaagtctgaagtcatttaaattgtttcctttttgtaggctgtttgtccttgctctatggcttcatttaagatctcctctttgtttttgatgttctgtaattttgtcaaagtgtgtttggacacaaatttctttttatatattctgattttatttatctcagtatattgtacttttgggatttttaatacatattttctgatagttctaaaaattgtatctttttaatgattttcttttatattcctgagattccagttagttatctatttagtcttctcattctgtattttatttatcttagtgtctctttcacattcttcatcacaattctatttttgtcttacaaatagattatctcctggaattcttaatgatgatgatgatgattattttcgttttctcccgttttctgaattgtgtttcatccaacgtttgtatttttatatttgttgccttggtcttcctccttcatgatgcaagcattccttgaatatctgatggctgttgatttccatttatattaaagattgagcagataggaaggaaacttatataagtgggcaagggttatggaatagtctttgttgctttatgatgtgctgttgtctgaaggttttcggctcccaccaaatttatatgttgtaacctaatccccaatgtgatggtagtaaaaggtgcagtctttgagaggtgattaggtcataagtgtggagctctcatcagtggaattcgagcccttataaaagaagcccaagggagctcattggccccttccatcatctagggacacagcatgaaggcgccaactatgagcaatgaaccctcaccagacactgaacctgccagtgccttgatcttagacttcttggcctccagaactgtgagaaatacatgttgtttataagtcatccagtctatggtatttttgtgaaagcagtccagcagactaagatatagtgagagagatcggtgcttcagaatctgctgacatcttttggttgctgacagcttttcctgttttctttgccataatgattttccctcttttcttagctcattactcttattttaaggaagcttaaagggaatatcaatagctcattctaccatcttgaattaaaagccacatgtaattttttaagaagaacactctcattatattaatctcttgcttgaaatatgctccttgctgcccattgctcatagaacaaagaccaggatccttacgttggtccccaaggccctgaacagccttctccccagagaatttccaccttcaccttaaatcatgctccatctggctttctgtgctcttttctcttctgctagtccacaatgactcctcctgtctaagggatgtgcacacatcatatgctctctgtctgcagggcctttctccttcctctggccctcacaacccctgctccacaactgcaacctcctaatagatcaatttaccctcttgtattatctcagagcatcagagatcttctttgtagtacttatcaaagttgtgatttttctttcatttctatgactatttgattaaatctgtctcatccgcaaatagaagtgggcagctgatcataatcctgaaagacacagtacctagaacaccataatcttgaatgttgaaatcctagaaagtcaaaatttgcaaagtctaaaatcctgaaaataacaacactgaaagatcaaatccccaaattataattctggaagaaataatataaaaaattatattagaggtatttatttatatttttaaagggggatttattggaaaaacataaaaacatcatcgagaaacatgataggccactttacacaataaaataagcaataataacataaatatttttgcaagcataaacactcaggtatactaatgatagtcacatgagcataacagttaggaacagacagcacatattcataaagaaacaggctaaaaagggaaatgtataaattcacatcactatggttggttattgtgtgcacccagctttctaactacagtcgtctgaaataccatgatgaacaaccttagtcttttgacgagtcaatcaaaactgcaaaggttcgccaccgcatttgcaatcgcccaaagaaccaagatctccagaaattgcatctttcacagatacaaatgtacaaaaaggacatctcttcatttattgaggaagttccaatgtttatactttgagaaccagggatgccgacgatgtgtctctcagtccaaggttgaaaacctcaggatcctgggagctgctggtgtaagttcctagagtccaaaggttggcgaacctagagttctgatgtccaaggcagcagaagaaacatctgtcccagctctcagagagagggatctgtgcctcagaatccgttgtaagcttttgttgctgacagctttttccaatttgccttctgtatttgttctttcctggtgcccagcgaattggatggtgcacctgacaacatggaaggcaaatcttcctcacttagtccacccagattcatacggtaacctcttctggaaataccctcacagacacactcaaaataatactttaccaggtttctaggtattccttcagttcttaatcaagttaacacctaacattaagtccactggtgaccacattaagtcactactggtcaacgtgggtaacttggcacccatattcctcgccttaaaccatgcttaataacaagatggctagatctgcctaacatgatgcaactattttctgatagtgattttcaagattttagatattagggattttaggctttagggatttgaactttgagatttttggtctttagggatttcaatctttcaggatttcaatttttgggatcatggcatttgtgattgtgtcttttgggattatgatacaaacccaacaaggggtcagattgggtttgaaaatgagcaaaattattttgtaaaaattataattatatgttatataattattacataataattttgctcattttcattccttagtctccatgtagtgaatgaatgcataactgaatgagagatgaataatagcagtaaaggaccttggatggtttatcttatgctattttttgaggatattcaggagatctttgttgaatctgttccatgatcatggtaagatgtttaagctgaatctcagactcaccgagatagaagtaagtgatgatgaagtaagtgatagaactaagtgatgatgaatgtggcttccagtatgaacatgacttatttatgtctaataatgtgttccatttgtacagaactttaggctttttaatatagtttcacatattcagattaattttatcttcatatttttatgagacattttgttggttcatttagatgaactggaataagactgactcatgtctctgcaggttatgagacacatttagaaacgaagatgctaggatcatcaaccacatggccaggcaacaaagaaggaaaggaactgtcactcatgtgtacctttccgaaagtggagcctggaaggctgtttgagctcccaggcagtctggagcccatgctgttccattgctccttcatgtacaacccacggagcttcacctgaccattaacttcactcagtttgattcccagcacaccagcctctgtctatgtctctctcacatcactttccactatgaattatgcttgttcttcccctctatcacttctatgctctttcactctacatcttttattaaaatctcagagagagagaaaaaagattggtcttagggcagaactctcatagtaactaagtcacaggccgcctgtcctgtatgatgtggtgtgcaaagcactgttgtcttaaagtgctctggaagctcccttctggttgttggacagcatctcagctagcacttccccttgttcccagtggggaagcctcaacccaatttcagcttcccatgggaccaatatcttcctttttcagggtaggggggatgcatctgaacccagcttctactgtgtcttcaaggcttccgtattctggggatctggactttccaaacagttgcttcaaacagctgacatctaaattcatcctgcctggtgccccggtagctggattattcccttacttacaagattgctctcacacttgccttgtttaaagggcaggcagcctagcagaggggaacttcccctagaattcacagccacactgcctgcccaccacagtgtcttggcccaaatgcctttctatggcatcagagggaaaatcaggggcctgtgctttcttttgcttacttaccttggcttgtaggcactttgctgaaatgtgttaggttggtgtagtgggttgaacagtgtttcccaaacattcgtgttctcctggtacctcagaatctgaccttattttgaaatagagtatttgcagatgtaattaagttaggatctggagatgagatcagcctggacttactataagccctaaatccaaggactggtgtccttctaagagagaggagatggaaatttagacatgaagacacagggagaagaaggccatgtgaagacggaggtagaaattggagttgtgtgtctacaagccaaagtatgccaaagattgctggcagataccagaagctaagagaggcatgggaattaacactgcctacatctcaattttggaccaaatttctattgtttaaagcaaccagacatgtggaagtttgttatggcagccctcagaaatgtaaacagctgggtttcctagaagtagaacctgagaagggggttctcgtgcgagggactgatgaaggattggttgaacaagggttaggtggggagctgcgtaagtcagggatgtggtttcagctggggactggcctctgtctgacctcacaggctggctctggcgcacagagcgccctgcagggatatgatccacctgtggcaatagggccaatgctttgacccctaggtcagccagttactgactgtgggctgctgggagtgagcaatgcctccagcaggagctgctttttatttgacagaagacagctctccgggacagggtccaccaccgcggcgattatggcaatcgttatttcttaaggcaaatcctgtgaagttatggaatttgttacgggccctggtccataatggtggcagccacgagaggacgtgatttgcgtgagtaacacccacaaagggaaccacgttgcacagcacagcagatgcccaccattccggcagttatctgtatttgggaagggggaggttgtatgatacagagaggaagagggaatttggctggggaggccaccaaaccaagacaggcagttggacatgggcagggctcctgctgagggaactaagacagttcctaaaactgcctgagctctatgcagagccacccgcagcaggaggtataggacacaggtctgacatgcctataactgagaggaaagagataggcaataaccattaaatcaggctgggcacagtggcttatgcctataatcccagcactttgggaggccaagatgagtggatcacctgaggtcgggagttcgagaccagcctggccaacatggtgaaaccccgtctctattaaaagtgcaaaaattagccaggcacggtgacgggtgcctgtaatcccagctactcaggaagctgaggcaggaaaatcgcttgcacccaggaggtggaggtagcaatgaaccaagatcacaccattgcactccagcctgggggaaaagagcaaatctccatctcaaaaagaaaaaaacagaaacaaatcactttttaaacctattactagcaaaacatttaaaaacagaagctagaagtatgtgttgacacaatagcacattttatcagcccttattatgaaaattctgtgtcaattcccgtccacctgactttgaagttatcagcatgtgtagcaaaagtgaatatgtttcatggcctctttcccatgaacgtattcacattttatgaaataataaaattcgcataaagattacatcataaactccagtctccattttcccctcttcattgtatgcgacatacgcacgttccctgaaaataaaatgtgcgtgtaaaattaactggctattttaggttgagttcccagtgtacctatttggaatgcctttccaagtcaaaacaggttttgaggctgtaacaatagcatcacaaataaaacaagttggattcagagttttacctaaagtaattgggagtaaaaaaggaattgttcaaggttccccactatatcttcatacttcctttcgctggctcttgatttacttagagatgcagttaagatggaaatgagccatgcccagagggatggagaaggcagagtgagtgagttccggtgttgcttttatgaaccacgcaagtgctctttgcagaaacctggtccggaagccttcccccgtgtaggtgcggagaggagaaattgctcacagtctgaaggaatagcatgcacaagaacacattttcaaggggttctgctttcaaaactccacctttcgggaaaaatgtaaaaggtgctttgagatgaccttcactcttgtttattcccaatactccctcctccatccgtttcaatcattgcagctcagaactgcgttatgacagcagcctgaagaggaacccaggcctgccttataggacacccagcccatggcctgctcaatgaaaatacctggtaaaatgggcagcatggttctatgctaatgaaagctcgtgcccttaagtggctttctgtccctcatgtgggctgggtggcctgtctcccactgcgtgaagcctacagctctttacactgcccaactctgtttcttggtttagtttgactctgcagctacccttgggcatgccctggagtccggcagcctgggggtgctatgccatgtccaggctgcctcgtgtttaccatgatccccttggctgctttctttctttcattctaaatctcctggaagtttccagaagaaaagactgccaacttctcaccttggcaccctttctacctcttctgtttttgcattttacttttactttcaatatgcctctgcatctgtttagtaacaactaaaaagttttcctagctaggttatgactatctcaggctttgaagctctgttcttcttaccagccacatggttagggctgcctaactaacctttctgtgcctcagtttttttcatctggaagatggggatcccataataacattcgcctcctgtagggttgttgtgacaattaagtgagttttcacacaaataaggtttagagctgcacctggccatttgcaggtgctgagtgttagctgtagtttctttttctacacccccaactgttctgaaagacggtaagggctgtgagccctgacttggccgttatcagcaattttgacaatattgcattctttttccatggaaaaaactcgaataactcttacagatgagtttcaaagtcaatacaagatcatcactgtattctacagttccagacttgggtgcagtattggtgcctaagctggccaatttcctagccattggaggtgtgagtctcacggcactactttaatactttgatgctgagatgccaatagagaaagaaaatattgaaaagttgagaaactgattctgaatttggtttttatattttgataaaaatgaagagaaactaaaagaatttaaggagaccagtcttttaagaaatgttcaagtctactttttgttttgtctagggaagaaatgaagaccagttatacagcaactcccttttgtttttaggaagataattggatataattttgagaatgttccttggtttaacctcggggaagagttcagtgttattgttaaagaaaaaaaaatgacctttgataaggcagtaaggcagactttattcagagccatagagaccctgcaattgcattttgaagtgggcgagagagattgggcacaattccaaatacaaaaaacaaatgggagtttatagccaggtagtgaggtggggatcagtggatggaatattatttacaggagacatcaagggtaaggggcattctggctacatcacctgaacatgactcttgctgaacacagaccagggtgatcagacaaccacctgggggttggtgaaggagaaacctgatcagatagttagggtgatcagatacccaggatagccaaactaagcaggattcttgctaaaactggagaaggcagagacaagaaaaaatgctccaaagtcagggcttagttgagaagagcttagagaggggcctgcctaaagtctggtcagggaaagagtctgtcgtgatacacagttaagcacaagactcttggcagatgctatgagatccacctctccagggatggttgaaggaggctggcttggatttgggactctctgaaagggctctcactgtgaagacagcaggatgctgacaatacccacctgtgtccaccacagcatgcaggcctcatctacttctccacccacctgtgtctgccacagcatgcaggcctcatctccttctccccatgggtgcagcacagctggccagctttgaggttggggtcatctgtgggtctctgaccagagctcccacattccctaaatggaaaatgaaacctgagaattttctgtgctgcaccatctttgctagaatacttggctcaggaccaactatcaagaatatgagagaacaagtagtgtatcacagagatgtaagtgtcaatccttgttctggaatgttccctgcagtggggattcagcacagatcatggccacttatagccttgggaagtgagagcagagggttggggaagggcccccatgagcctttcaggtctagactctagtggattaataggagcagacatccccagctgccctctagagatagttctaatattttagtcaccatactacttcaccctgacatcaaaggacgtcttcaatatgcatctctttgataatctcccctcttgggtgaatttcagcctgtctcaattgggcctccaccttccttttcaaagaaaatgccttgttttttcctcttgttctataagatcttccatacccctatgctatatccgaggtctggtgctcaacttctgttctcagtaactactggcttttgtttctaactttcactacaattacaatcaacgcaagctttgggaagcctgcttttaccttgaagcacttccacatcaggaggtctgagtgcagaggtgctccttacaacagatggattgctgcacttaccggggaaaggccatcctgtgatgttcaccaaaactaacaaacacctggaaatgggaattgtgtttaatgaaaataaactgaagctggcttcgttcattatacccaaaatattagccatctctaatcttttcctcacaggttatgccctgcaggaattactgggagggatagagaagaatgctttcggttagtgaaagacaagctgtaattgttgggagcactggatgagaaaatgcacataaaatcacttggaaacttggattagcatgcaggacagataggttctgaagctcttcccagaattatcacactgcagcccctcagggtgggggtggggggaggggtgtcaccgtaaggtaatgaggcaggtgggaaggccacctgtcttggctcagagccactggggtgccatctgggtgcaattcaggcagggggtgactggccacctgtcctggctcagagccactggggtgcaatctgggtgcagttcaggcaggggtgaccatgttttctttaatgaagttatagcctatgctatgtgaaatacctggatgattccctaaaatcgactttaacagtgtttgcctatattagtcaactttagagtgttttataagtagttttccacttaatcacattcattattcttgattttttttctttttgtccctgtcactgaacatttgcatatgtagacaaaataaaatgctgtatatctcatagtgaaaccatgtaacatgcacacacgcacacacacacagggagagagagaaagagagaaaatggtgagccatgtatcaatgatcataactgactaaactggcaatgttaaactactgcgggttctacctctcaaagatcctgaatgtcacaggtggcaccatccgtagaaatggtaattcatcccgtcaattagctgtgatgctcaggaccaaatgttagcaaggctgggattaatagcaagtgatcatttgcatctggcattcaattgggagctgccatgagatgctcccaccctggggtctctgttctaaatatacgacaggctgatactttgcaggaaggttcattctcaaacataaatagcacacatggtctttgcattttgcctcccatcctagctggagaagcttattttgtatgtcatcctaaaggtcaactttctcacgctaaaaaagaaaatgggcatcaggcgaaggtgcagggagcgcagagaatgctcagtgcagcagctggtggttgtcctgtacctgcttcgtgcttgtctgtgtgttttgcccaaagtgatgtgggcccgaagttactgccaggatctgtctgtgccctagttttgcccaattctcacgtcaccaattctacgacccttatttcagattgaaattttttcatgtgagacccactacctgaagaaggcaaccctgcttacttactctagtaggaaaaggaatgctggttttctcagagtgaaactatttaaaatcttaccccttatttttccaaacacacccctcccacagtgctcctaacatgttttagttgacaattaaacgtctttgtgaattagtttttttgttccctgttccacatttcccctacccataaggcttacgtatttcctgtaaagcaagtacccttcttttaaaacaaagaaccatgaaattaagaaaggttttttggctggacacggtggctcatgcctgtaatcccaccactttgggaggccaaggcgggtggatcacctgaggtcaggagttcgagatcagcctggccaacatggtgaaaccccgtctttactaaaaatataaaaattaggcatggtggcatgcacctgtaattccagctacttgggaagctgaggcaggagaatcacttgaacctgggaggcggaggttgcagtgagctgagattgcaccactgcactccagactgaacaacagaaagagaccctgcctcaaaaaaaaaaaaaaagttgtttttttttttttttttttggaattgttgttttgtctttttaaaaacattagtgatggtgaccaaaacttggaacttggaagctgtcagttgggtgaggctttccaggctgtgttttctccatctgatgctcttctagcaagcattttctttcagtaaaactcccaggggaaaagaatgtgaaataactactttgtaaatgataccaagcctcaatgttaatgttcagtattgatattgaatgtctctcagcattttagttagttatgtgtcatcttcccttaggtttaagaatgtcatatatcagctatcctgttaaggatatgtatttaatcctttgaaaatatatatatatatacacacataccaaatacatataaaattgaaaggctctgttttatatttttatgtatggggaaaatggggagaatttcaacttactttgtaatcgggtcctaacagttcatgatttttaataagtagcaatcttaccagcagtgctttcccaccgtagatttaattagtctttcttcccccacccccaaccccttttgctagttgacggagctgagaggagggaaacggccgcaatttgaaaccttgttagaaatttatgaagtgctaaaatgttttattcccagaggctggcttgccagctgtcacgagctccctgcctgcctccgcggctgtgatagcaggggtaagagggaggctgccagagctgcacagggtggggaaatgccattcccatcagcagcacagggcggaggtcagctcctcgttctcctgcagctgaccagccacatgtgagatgagaattcaggggatctggagcgggcatcggagccctagagtaagaccctttgcggctgttgataacaggcactgatcgctgatcatgcaatgagacgtcagctttggttatagaaattaaacaaccattctgttggtggcctcaaacagataattggcctcttactagcaaaatgtccctgaactaattttttctggaggaaacaccttctcacaaatgttaccaggtgtgaaggatgttcttcccggggtcatagcctacctgcaatgactctctgtgtccccatccctcccccattgcttctatgatgcctggaatgtgtctctcaggaaacaaagtttaaaaaaattttttttctttggtccttgaatggaaatatcacttgcacactgtggtcatagataccccagagaataaacaattcataataaaggtgcaaatcacccacgttagatgctgagctggaggaagtgctaagtctgacatgatggagaccaaaaggccccacggaagcagaggaggaggaggaagtgcctcctccagggccaggggctgggccaggcagtgccttcatgatttgcctccaagttgctctgcgcaaggaattgggcatggaagaaggagccagagacctcagaaatcttcatggcaatgacattggttaggaaagtatgccctcagcaccctctcctacttcctctgcctctccaaaccaacaattatagtaagtacttttggttccacagaactttctgacaagttctttttttttttttctgtgatacatgtgcagaatgtgcaggtttgttacataggtacacatgtgccatggtggtttgctgcacctatcaacccatctcggttttaagccctgcatgcattgggcatttttcctaatgctctccctctccttgccctccaccccctgacaggccccggtgtgtgatgttcccctctctgtgcccctgtgttctcattgttcaactcccacttgtgagtgagaacatgtggtgtttggttttctgttcctgtgttagtttgctgaggatgatggtttccagcttcatccatgaccttgcaaaggacatgaactcattcatttttatggctgcatagtattccatggtgtatatgtgccatattttctttatccagtctatcattgatgggtatttgggttggttccaagtctttgctattgtaaataatgcagcaataaacatacatgtgcatgtgtctttatagtagaatgatttctaatcctttgggtatatacccagtaatgggattgctgggtcaaatggtgtttctggttctagatccttgaggaatcgccacactgtcttccataatggttgaactaatttacactcccaccaacagtgtgaaagtgttcctatttctctgcatcctcaccagcgtctgttgtttccagacttcttaatgatcaccattctaactggcttgagatggtatctcattgtgattttgatttgcatttctctaatgaccagtgatgatgagctttttttcatttttttttttttttggcggcataaatatcttcttttgagaagtgtctgctaatatacttgacccactttttgatggagttgtttgtttttttcttgtaaatttgtttaagttccctgtagatcctggatattagccctttgtcggatgggtagattgcaaaaaatttctcccattctgtaggttgcctgttcactctgataatagtttcttttgctgagctgaagctctttagttaattagattccatttgtcaattttggcttttgttgccattgcttttggtgttttactcatgaagtctttgcccatgccaatgtcctgaatgatattgcctaggttttcttttagggtttttatggttttaggttttacatgtaagtctttaatccatcttgagttaatttttatataaggtttaaggaaggagtccagtttcagttttctgcatatggctagccagttttcccagcaccatttattaaatagggaatcctttccccattgcttgttcttgtcacgttttccaaagatcagatggttgtagatgtgtgctgttatttctgaggcctctgttctgttccattggtctatatatctgttttgataccagaaccatgctgttttggttatggtagacttgtagtatattttgaaggcaggtagcatgatgcctccagctttgttctttttgtttagagttgtcttggctacacaggctcttttttgattccgtatgaaatttaaagtagttttctctagttctgtgaagaaagtcaatgttagcttgatgagaatagcatttaatctataaattattttgggcagtattgccattttcataatattgattcttcctatccatgagcatggaatgtttttccatttgtttgtgtcccctcttttttctttgagcagtggtttgtagttctccttgaagaggtcttatcgcatcccttgtaagttgtaattccaggtattttattctctttgtagcaattgtgaatgggagttcactcatgatttagttctctgcttgtctattattggtgtataggagtgcttgtgatttttacacattgattttgtatcctgagactttgttgaagttgtttatcagcttaaggagttttagggctgagatgatggggttttctaaatatacaatcatgtcgtctgcacacagagacaatctgacttcctctcttcctatttgaatgccctttatttatttctcttgcttgattgctctggccagaacttccaatgctatgttgaatagcagtggtgagagagggcatccttgtcttgtgccagttttcaaagggaacgcttccagcttttgcccattcagtatgatattggctatgggtttgtcataaacagctcttattattttgagatatgttccatcaagacctagtttattgagagtttttagcatgaaggtgttttgaattttatcagtccttttctgcatctgttgagataatcatgtattttttgtcattggttctgtttattgatttgtgtatgttgaatctgccttgcatcccagggatgaagctgacttgatcatggtggataagctttttgatgtgctgctggattcggtttgccagtattttactgaggatttttgcatcgatgttcatcagggatatcggcctgaaattttcttttcttgttgtgtctctgccaggttttggaatcaggatgatgctggcctcataaaatgagttagggaggagtccctttttttctattgtttgaaataatttcagaaggaacagtatcagctcctctttgtacctctggtagaatttggctgtgaatccgtctggtcctgggcttttttggttggtagactattgatttactgcctcaatttcagaacttgttattggtctattcagggattcatcttcttccttgtttagtcttgggagggtgtatgtgtccaggaatttgtccatttcttctagactttctagtttatgtgtgtagaggtgtttatagtattctcttatggtagtttgtatttctgtgggatcagtggtgatatcccctttatcatttttttattgtgtctatttgattctcctctcttttcttctttattagtctatctagtggtctatctattttgttaatcttttcaaaaaaccagctcctggattcattaattttttgaaggtgttttcatgtgtctaactccttcagttctgctctgatcttagttatttcttgtcttctgctaggttttgaattcgtttgctcttgcttctctagtttctttaactgtgatgttagggtgttgattttacttctttcccactttctgatgtaggcatttagtgctatacatttccctgtaaacactgccttagctgtgttccagatattctggtacactgtatctttgttctcatgggtttcaaagaacttggttatttctgccttaattttgttatttacccagtagtcattcaggagcaggttgttcagtttgcatgtagttgtgcggttttgatgctctacatgtttagagaaacttctctagtaatgaactatagaaatgatccctgaaagtactcttctgataagttcttttttaaaaaagtaaacgtaccagggcactctctaattgggatcgtttctctctgtattagtttgttagggctgttaagaaagcatcacaaactgagaggcttgaacaagagaagtttgctctgtcttgcagttctgtaggctccaagtccaagatgaaggtgtcaacagggttgttttttttctgagagctgtgagggaaagatctgttccagtcctctctccttagctggtggatgtctgtattcatgatcacatgatgttctccctgtagtacacatctgtgttcaaatataagatgagagatggaggggtggaggagagaaaaaaagagggagggcgggagggagagagagagagatgctatgttgttggctttgaaaatagagggggggccatgagccaggaaatacatgtagattctagaagctagaaaagataaggaaacagactctctcctaaaaacatttgataacaggtaccgagctgggagacttggagcagataagagctgtacttagatttagcaaaactgcatcttcgtgatgagccagactcaaggatgataaagtccactacttggaaggatcatggatgcagccttgggtttaacttgaagtcattcactgagttcagataccagactgactctttccataaggaattgcctggttaggtgagggtagaaattcaacaatgactgttgcattccagaagaaggaaggcaaagagccaaactccaagttgtgctttgggaatgttgtgattataagtaagtgcatcagctccaggctccccagtgtcacatgcacacactatggggactgatcgtgttgattctcagtgaggtgtcttggggaccctgtcccagctgggaaggtagggatgtattagaaggcttggtgccaggtgcagaaaggggaagattctggaggccaggcacagtccatgagctgtagccagagatatggcatgagaataacatctaacttcccagaaaaacagcacagccaagccaggcatcagtcaaggatcacaggaggagagatttgcaggaaagcaaggttcctctacctgggtggcaaaatgccacagctgctgaggcttccttgactcttgcctgcttgaaactggcaaagcagtgactgctggtggctatgaatgcttgttaaatggcccattcttactccctgactggcctgtgcccaggacctctgcagttggatagaaagacagtgtctctagggtaaggcaggtcagaatcaaacacaaattccactcagtatgacctgtggctcctgtgcaagctaacgtcaccctctcagcctcagtttcatgatgtaaaaaacaggaggaattctgaaatatttgaagcagctgtgaagcaagggccaattgaatcaataaatgtgaatgtggctgggcgtagtggctcctgcctttaatcccagcactttgggaggccatggtgggcagatcatgaggtcaagagattgagacaatcctggccaacgtggtgaaaccccgtctctctctactaaaaacaataaaaatgaaaaaaaatttcaaaaattagctgggtgtggtggcatgcacctgtagtcccagctactcgggaggctgaggctgaagagttgcttgaacctggggggtggaggttgcagtgagccaagatcctgccactgcattccagcctggttgcagagcaagactctgtctcataaataaataaataaataaataaataaataaataaataaataaataaataaatgtaaacgtatccaatacagctcctgattcttcatggaggcaaaaagatgaatgcccctctcgtcacctcccccttttgatgtgtggagggcgatggctgcattttcatctgggacagtgatggagatagaaggcggcagtgaggaaggaaaaggagggaagcaaagactggcaccccaggctgtgcaatgactgctgccaggggcaggctcatgggatgatggcaggagggatggggagctggctttgaagtcctggactgaagccagaatggttctcatgctcccgtagcaagtgctccgaggccagccccagcaatcaacccaactgagggcagcacagaagagtctggacagcccactccccgccgtattgatgtgcataattagcctgcaggtgcaccttgactgggggacagagagataggcaggccagctggcaggctgcccccagggatatgggtatttatccatgatcagaagggcacaagcgagtcacgtgcactttaaagatcattcagttggtttttttattcaggcttaaaaagatgtaatccagcctgaaaagattccaggggcaatgaggaattcaaagcagagccggctattaggtgaccatgatgcttggagaatgtgggggcaaggaggagtcctgatgcatggggtcatggagagtggtgggagtgagatgggcactcaggataggcttggagcacgtgggaggctgagagcctggggactgtggaatccaacctggaatcctcttggatggactgggagactcaatgccaagagatgagacaggatgggactaagagcaaaggccccaggctgggaggagctatgtgtcccttctctctacccttctctccctctcctttttgtgcctcctcactaccccatttcacaccccttccaggcagccttgtgcagtccggatccctgtactctaaggattgtcacaagcatacttgcgttctttatttatgatgatctattaacaagaataaatggttgtgggtcagataaagggctaaaaatcaaaagtcatccttaacatctttaagatgctactatgtatcatctgtcagggcatgagggtcttcatcaggcccactaaagaatcccatttctcttgaaccaagtgtgtcatgactgggaggaagacaagaccatttggggtgtgaagttttgggctagaggcccttttaggagccaggttagcccccagcttccccaagaaaccaagctgcccccctcatcctcgcctaagcaagcagctgatgacaaaaccggagttggcctgaggggttcaaaggaaaaccataaatagaccccccaaaataagaaaatcatgtaactaaattctttccactttatgccagcagtcaccacacctcctgtcctctgtatctcagttttaggtctttttttttttttttttgagacagagtcttgctctgtcgcccaggctggagtgcagtggcaccacctcggctcactgcaagctccgtctcccgggttcacgccattctcctgcctcagcctcccaagtagctgggactacaggcgcctgccacagttttaggtctttattctgtgttcctctttatttttttcccagtccctttttctgcatctctcagaatatacactaatgtcctaggacagccgtaacaaagtgccacacattgggtggcctaaaacaggaggaatttattttgccatagttctagaggccagaagtctaaagtcaaggtgtgagcacggtggtctccctctgaagctcctggtgggagtctgcttcgcctctctctgtggctgctggtggctgccttctcagtccctgttgtcatatctatcataccgtgttctccctgtgggtctgtgtctgcctctctgggtctttgtccagattttcctcttcttataagaaaaccagtcattgaattagagatcattgtaatccagtatgacctcatcttaatttgatgacatctacaaagttcttatttccaaataaggtcacatccacgggtactgggtgttaggacttgaacttaccttttagggggacacgattctgtccactgtgatggatatacgtgtattcccccacatgaaacagtactccacacatagggaggattcaatcgagacttgatgccaaaacttagtggcccaaagtggcaaacatttatgatttctcatgattctgtgggggcagctgtgcagctcttctagtaaggagaggcactctcttgattctcttaagtgtctgggcttcaaatcggatggcaggcacaactgggcctcagcacatgctctttaccctctggtggactagcctagcctagtactcgggtggtggacccatgtcccaggaagccacaatgctcatgcccttcccaactgcttgcatcacatctggcaatattcctgtgactaaagcaagttgcatggccaactccagattgaaggagtagagaagtcaggggagcagccaagtcacgttgcacaggacatgcatgaggaatgagagaatttgttgcagccattttttgcaaatagtctaccatagaagctgagtgacatgaccttttatatatgtggaagagtaacaatatatacacatgggctgggcacgatggcttacgcctgtaatcccagcactttgggaggccgagacgggtggatcacgaggtcaggagatcgagaccatcttggctaacatggtgaaaccccgtctctactaaaaatacaaaaaaaattagccgggcttggtggtgggcacctgtagtcccagctacttgggaggctaagcaggagaatggtgtgaaccccggaggtggagcttgcagtgagccgagatcatgccactgcactccagcctgggcaacagagcaagactccatctcaaaaaaataaaataaaaataaaaataaaatacacacacatacacacacacacacacacacacacacgaccatttgttgggcaatctttcttacaggctgaattgtaaatattccagagataaatcgcacagacttgggagttatatcgtctggcttgcaatactacctctaagatgtgcaaactgtatggcctttgaccaacctttctgtgcctcagcttcctcatttataaaacaagaataataatacctccctcctatggctgtgagttgtaggataaaagaagttaaaatatgaagtgtttagtacagtgtatttgtctattcttgcattgccataaagaaatgcctgggctgcgcgtggtggctcatgcctgtaatcccagcactttgggaggccgagatgggtggatcacttgaggtcagaaactcaagaccagcctgaccaacatgatgaaaccccatctgtgctaaaaatacaaaaattagctgggcattgtggcaggagcctgtaatcccagctacttgggaggctgaggcaggacaatcacttgaacctgggaggcagagattgcaatgaaccgagatcatgccaatgcactccagctagggtgacagagcaaaactctaactcaaacaaaaaaaaagagactgagtaatttataaagaaaagaggtttaattggctcactgttctgtaggctgtacaagaagcataatactggcatctgctcagcttctggggaggctgcaggaagcttagaatcatggcagaaggcaaagagggagcaggcagctcctatggccagagcgggaggaagagaggggggaggtgccacaaactttcaaataaccagatctcacaagaactcactcattatcgtgacagtaccaggaggatggcactaaaccattcatgagaaatccacccccatgattcagtcacctcccaccagaccccaccttcaacattggaaatgacatttcaacataagtttttggcagggccacatatccaaaccgtatcatacagtgacatgcataaagcaattactaaataagtgctatctgttttaatttaattcccaacttcttgcatcagatctgccaatattcctgtaactaaagccagttgcatggcgaacaccagattctaggagtagagaagtcaggggagcagcaaagtcacattgcaaaggacatgcatgaaggatgacagaatttattgcagccattttttgcaaatagtctgccatagaagctatatgaatatctcatttcaagatgtatgagcatctcattttgctcttaaattcacatcagtaaactttggaatcccctacacaactcgcctataccttggggggccagggtgctacctcagtcctgctctctgccttatctttttattgcagcattttcactctgctgtggcctctcagggtaggggagaccttccctttccttttctccactcctaccaatccagagtttctatcatctaaaccatacccaccctcaaatctaagattcctctcaagaatccaggcaacatctttttaaaaacttttttattttttatttattttttagcaggtggggacagagcctttttatgtcacccaggctgaaatgcaatgacatgatctcagctcactgcaaactctgcctcccgggttcaagcaattctactgcctcagccttctaagtagctgggattataggcatgcaccaccacgcccagctaatttttgtatttttagtagagacagtgtttcaccatgttggccaggctggccttgaactcctgacctcatgatccgcccacctctgcctcccaaagtgctgggattacaggcatgagccaccgtaactggaccctaggcaacatcttaacctcatccttatcccccaaatctctccatgtcctgcccactgcatcatctcccttcctcttccatgttgtgggaactctgtcctgagccatattctaagtcttcacaccatgtcttgtggcaaaactccatcattagacctccaagctttgttctgccttaatgcagaaggaggctttgggaatttagaaaactctcttccctctcaattgtcctataaatccagactttcaaatgaaatgcttaccatagacttgagaaacaaatcagaaactcagagcaaaaccctgagtctttattttaggctgtatctttctttgaagcaatggctgccatcaactccgtgtgtgaaggagacacaggacaattaagaaacaaaaatgagcggtggtgttgcaggtgctgttggtgcctgcctggagcctgtcacctccttaccatttcctggcagcacttccagctgcccagtagcaacacttcccctaaggactctctttggcaggtgaaagtgcctgagattgactcctgagagcagccacggccagtgacagccggaggtggtgatgtaaacctcagctagctaggctttcaggaagagtaactgaggcagggtcctgctctggttctcagtgtctccaagagatgaagctgccatttctcatagtggcgacttgctataatgtgcccttcattgaccgtcttccttttattgttcacttgcctcctttcctgcctgtgtttcctgaaaccaactacctcacataaactacttttgcttgaatccctgtcacagagtctccttctgggggattctgaaggtagacacatttaatatgtcaaaagtattgcacctgttgtgtgttttaggggagtgatgattagcagaaaatagaaaggaggctattatagtggtcctgggcatgggagaacaagagcaggtgctgataaaatcaggagaacttgaatagtggcagagctggcagaaacacggaggatgtgtcggagggtctggtgtgcggttgctccccacagcggagtctgagcaagaaaagaggctctggcctgatggcaagaagacctcacggctgtttcttgccattgctgtcactgtcatgttcataggttcactgcccatagcaactgaaagaatgtcaaatgcttgcacaacccccttcaatttgtagatgaaaactggaagtgtggacaggttaagtggaagctcaaggtcataaagccagccagctgcagaaccttgcactgtaagtttttgttcgtgacaaggcccagctccacttcaggtgcggttcagatttttgtcttcattcgttctataaaacttcattttttgctttttacttctcgactcttctaattgtcctttgtatgtctattaggtgtgggtcccccattaggctgatctgtagcataatttctacaataggaaagggagataaataggacatttaagatgcctggactcatctaaaggttgtttaaaagcaattactaccattagtttgaagcctacctctggctactctgatagtaatgtgcacccagcaatccaattagtttggaaatggattagtctatttgttaccaatgtgtgtggtttaaaatcagtataatatacatctaaaggtgtgtccattttatctattgacactttgtataaatgtgttgcttcatctttccgtaggtaatttactcactcccttctcccatactaaatgtttcttcattacaaattgatttcctaaactatgattcatgatgtttcagtttcattgtctttattaaatgactgtaattctttctttagttttaaggatttccattttgtgtcaccacattggactaaccatggacaaccagattttccatagaatgaggtcattttctgggaactaacagaccaaggaataccccctgatatactacattggaggaatccttgcagatactctctccaaatgtgttaaataaataaaatagtatgttcatcaagtacctctggggtaccagaagcacagataagctggtgtccaacatggagcaagtctggcattgaggtgttagaagaaaaaggctgggctccctgaactctgttacatggtggaggctgaggggcctgttgtgtagattcaggtgcaggccacgtgacagggtgttagccatgtaagtccatattttctcccattgcttcacatctatttcatctattacttcattcattcaacaaatgcttagtgtctattatttaaacgtttctggggatatactagtgaacaaaacacttgcctttcctccttgcttccctcttctccccttctctcctcctttccttccttttgtaattctttactccccgctttttaaaattgagcttattttcagggcttcctttgaacatctgcattcttatccagttttggaacactatttgtgttgttgttgttctgttggacagggtctttctccgatgcccaggctggagtacagtgatgtaatcatggctccctgtgacctcaaactcctgggctcaggtgctcctctcgcctcagccttctcagtatctaggattacaaacacaagtccctgcacccaatctataaaagtatttttttaaataactgcatattttatcacatattgcctcaaatcttgttggtcctcttgccaaattgtcagatattagtggagacacaggtcagtttcccaaggaaaagcattaaacgtggtccctgcctcttgctgcagcatttggctgcaggaatgtgtgtggattccaagccagagggagggccccacctcattaagccgacctaggggagggccccagctgtgctcagtcaggaggaagaggtgagctggctttggagaaaagaagaggttacagcagaaaggaagcacccattcttgacagagtcttagggagccttctctcctttctggatacaaagcttcacactataataaaaccatgtggcttatgtagttaattggtagattattattaccatgtacaaagtgctgtcaggagtgcaaaagaaaagatgacctgcactttattcttgttttgactcttcttggagttttgtctattgggatgtttgccatccagttgggctatagagctaacaatgaatagtgtgaatttgctgcacagtgagctggtaatgcagcagataagcagaacagaggcatcagatcagtggccgaggagatggggatggggtcatttatattatgaatattggattacaaggaggtgatgcactctgcttgcttcaatgattttttaaatgtaactttgtctttttttgtcttttaaaaatgtaacttaattttttttacacaaaatataaacatgaatagaaccccacttaagaaatagaaaagtgtccttgaaaaggcccctgtgtgctcctctccaatcacgtccccaccccaccctacagtaggaacccctctcctgaactccttgttaactaatcctcaatgttctttgtagttgtaccacatgtttgtagccttaagtaatattttgctaagatgtgcatgctcttgaactttatgtaattagaatcacagaggaagagttcttctgggactagctttgttctccacattattgctttgagatttatccatggtgatgtgtgtagtttgttcatttattcaacaaataaattttggaggcaaatactgagtgccacacatggtttctggctgctggggatacagtgtgaacaaaacaggcggaagccttcatcttaaggtagctttattctagtgggtgtgggagagcaatgcatcagataaatgaatatgtagactagtagattgtaattagtgcaaagaaactgaagcagtgaagaagagtaattttaagggagacgtggagtttcagataggctagagtcggtctcgctgagaaggggcacttgagtgaaacctaaacgaagtgatagagtcctggggatgtcagcgggggtggaagagggcttttcaggcagagcaaacagcaaacaccaaggcctgcagcagcctgtgtgacaagagcagggttagcaagggagggacaggaaggggagatagggacagagaggatgttggaggtttttgaacagggtggcattatatgacttatgctttaacaagatttatctggctattgtgttgagcatagagctgaaggggcatggggactggagcgagggctccaggtgggagtcattttagtcattctaacgagagatggtgtggacatggggaaaggagcagcgtgctgggtgcatcacaaaggctgagtgtaggattttctgataggttggatttgaggtgacagaaaaagtgagaaatcaaggactgtagcctgagcagttagaatggcagagggactgctcatcgagtgagggaaacagggcagggaaggaagatcaggggctcagtaaaaagaatgttcggtttctgatgcaaattcaacatcctggtgcagatgtgagcaggcagttgggtgtagaagtttggagtttagataagaggtctggatcagacatggaaattttgttgctgccagcctggagatgatactaaaaaccttcagaacgggtgagatcaaagggagaaagggagtgagtacaaagagactgggaaagaaagaaagtccagagactgtgttctgggatccttcaaaacgtagaaatcaggaagtaggaaccagcaacagagacttagaaaaagcagcaagaaaattcctatcagagggaaaccatgcatgatcaatagtgtcaattatcactgctacagcaaaacacaggccactggtgactgcaagagcatgttcagtggagtggaggggacaaaagccagcttaaaatgagagactaggaggctgagggagaaagtggagccaatgaggtcaggcatggtggctcatgcctgtaatcccagcacattgggaggctgagatgggtggatcacctcaggttgggagtttgagaccagcctggccaacatggtgaaactccatctctgctaaatatataaaaattagctgggtgtggtggcgggcacctgtaatcgcagctactcaggaggctgaggcaggagaatcacttgaacccaggaggtagaggatccagtgagctgagatcacaccactgcactccagcctgggtaacatgtctcaaaaaaggaaaaaaaaaaagaagaagaaagtggagccaatgaaggattagaggggagaggctacgtgggagaaataacaaggtttcagacagttacaggccgccctttatacattcctctgtaggtgcacatttaagtcagttccatctctcagcttctgtgaacagcgctggagtaaacatggagtacagacatcccttcaacacactgatttcatttcctttagatctatatccagtaatgggactgctggctcatatgctatttctatttttaaatttttgaggatctttcatgcctctttccataatggctatacttatttacattctcaccaacagcgtggaagagctctcttttctccacatcctcaccagcatttgttaaattttttgtgtgtttttgatgataaccattctaaggtgaagggatatctcattgtggttttgatttgcatttccctgatgattagtgatgttgagcattttttcatatagctgttggccatttgtatgtcttcctttgaaaaatatctattcagatcttttgtccatttttaaatttaattatttgcttttttgatattgagttgtttgagttccttatatattatggatattaatcccttgtcagatgcatagtgcacaaatagttttttttccccattctgtaagttgtctcttcaatctgttatttcctttgctgtgcaaaagatttttaatttgatataattccatttgtctatttttgctcttgttgtctgtgcttttgaggttgtctttaaagaatccttgctccattccatgaagcatttcctctatgttttcttctagtagtttcatagttatggtcctaacacttaagcctctgatcttatttgagttgatttttgaatatggagatagtgatctagttacattcttctgcatgtggatatccagtttccgaggaccgtttattgaggatactgtcctttccccaatgagtacttctggtgcctttgttaaaaatcatttggatatacatacatatatttatttctaggttctgtattttgtcacattcatcaatgtatctgtttttacgccagtgtcatcctgttttggttactatagctatgcagtatattttcatcaggtagagtgatgcctgaagctttgttctttttgctgaagattcctttagctctccaggatcttttgcatttccatatgaattttaggattgttatttctattgcagtgaagaatgtcattgagatttttattatagagattgcattaaatctgtagatcactttggataatatgtatatttttaaacattatttcagtccatgaacatggaatatctttctaattttttgtgtcctcttcgatttctttcattggcgttttatagttttcattgtagggatttttcacctccttggttaagtttatttataggcattttatttataccttgtaactattgtacatggaattactttttcaatttcaatttcaaatagtttgctattggcatatagcaaacactactgatttttatatgttaattttatatcctacacctttaccaaattcatttattagttctaatattttttttttgatggagtctttaggcttttctctaaccatctatctaattatgatgatattgtctgcaaacagggaaaatttgactccctcttttcttaatttggatgccttttctttctttcccttgcctaattactctggacagaatcttcagtgctatgttgaacaaaagtggtgaatgtgggcatttttgtcttgttctacatcttagaaatgaagttttcaactgtttcctgctcagtatgatgttctctgtggatttgtcatatatggcctttattaaattaaggtgtgttgtttttataaccaatttctggaggatttttatgaaggaattgaattttatcaaatttttttcagcatctattgaaattatcatatggatttggccttgattctgttaatgtggtaatattatgtttattgatttgtgtatgttgaatcattcttgcatctctgtgatgaatcccacttgatcatggtgaattatctttttaatatattattgaattcagtttggtactattttcttgaggattttttgcatctgtattcatcaggaatattggcctatagcttccttttttgttgttgtattcttttctgatttttggatcagggtaatgctggcctcatagaatgagtttggaagtgttccctccttgtcaattttttggaagaattggtagaattcttgtgagaaagattagttgtaaatcttctttaaatgtttggtagaatttatcagtgataccattaagtcttgggagttttttgaatgggagattctttagtactgcctcaatatggttattcattattggtctattaagattttctatttcttcatgatttaatcttgctaggttgtgtctgtccaaaatttactcatttcttctagattttccaatttcttggcatatagaaatttacaataggctcttatggtcctttaaatttttgtagtatcagttttaatgtttcctttttcatccctgattttatttatttgagtcctttctctttttccttagtctagcttaaggtttgttgttttttttttatttaaacaaaaatacctccttgttttcttgatcttttgtattgtttttaaaacctctattttgtttatttctgctctgatttttgttatttttccccttctaatttggggttcagtttgtccttcttttctaatttcttgagttgtgacattggattttttatttgagatctctctacattttggatgtaggcatttatcacagtaaaattccctcttagaactgcttttactatatcccataggttttggtatgttgtgtgcatattttcatttgatcgagaaatttttaaattttatttttgatttcttcactaactcctctgttgctcaggagcgtgttgcttaatttccatgaagttttacagttttgaacatttcttctgttattgatttttagttttattccatggtggtcagaaaagacacatatgattttgatttttaaaaaatttctaagacttgttttgtgactttcataatctatcctggagaaaatatcatgtcttgttgagaaaaatgtgtattctgaatctattgggtggaaagttctgtaaatgtctgttggattcatttgatctagaaggctgtttaaatccaacgtctctttgttggttttctgtctggataacctttccattgctgaaagtaggggtattaaagttccctactcttattgtattatagtcaatctacagacctttcagatctattaatgttttccttacatatttgagggtctcaaatattgagagtcccagttttgggtgcatacatatttacaattgtaatgttctctttctgtattgatccctttgtcattatatcatggtctttttgtttattttttaccattcttgacctaaagtctattttatctgatataaatattgttattcctgctttttttttttgcttcaatttgtttggaatatcttttttccatctctttagtctgtgcatgtttttataggtgaaagatctcttgtagacagcatataattgggcatttttaaaaatccattcagtcactctatgtctcttaattggagattttaattcatttgcatttaaggttattattgttaggtggggctttactactaccattttgttacttgttttctggttgttttatagatcctttctaccttgtttcatctcttattgttttccttgagagattttttttttctagtagtatgttttgatttcatgctcattatttttagtgtatctattataagtttttgctttgtaaataccatgatgcttaaaatcatgttatagttaaaacaagttatcttaaactgattaacaacttaactttgactgcaaattaaagcaagaaaaacaaactacatttaacaccatcccacacacgttcatttttatttttgatgtttcaatttacatctttttatattaactcttaactaattgttgtaattactatctttaataattgtttctttagtcttcatacttaagatccaagtggtttacgttccacaattacaatattatagtattctaaatttgtctgtattcttacttttaccagtgaattttataccgttagatcttttcttgttacaaattagcacccttttctttcagatgaagaactcttgtcagcatttcttgtaagacagatctgatgttgatgaatttcctcagcttttccttgtctgggaaagtctttatctctccattgtgtttgaaggatacattttccatgtgaactattcttggctacaaggttctttcccttcagcactttgaatatatcatcccaatctcttctggcctgcagtgtatctgttgagaaatctgctgaaacttgcactggggctcaggtgaatgtgatatgttttctttctcttgctgctttgagtatttcttctttatctttgctttttgataatttgatgctgtgccttggttaatttctctttgggttgaatttgattggtgatctctgagctttttatacttggatactgtcctttttctccagatttaggaatatcttagcgattatttccttaaacatgctttctagaactttttctcttttatctcctggggaactactattatatagaggttagtttgcctgatagtatctcataattctcataggccttcttcaatctttttttaaagatttttctcctctgattgggtaattttatatgttctgtctttgaggttgtgggttctttaagtctgctattgaagatttcgaataagcttttcataaatttcaataagttcagttattgtattctttattcttaggatttctatttggatttttaaaaagtgtttctatttacttgctaaatttctcaaattctttcaaaatttcactgcattttccatccacattttcttgtgactccctgaaattaaagaggattattctgaattctttctcagacatttgatagatatttaattcttctgggtccattattggagttttgtttgtttcttttggtggcatcatatttccctgagattgtttttgttgttgttttgttttttttaaacaatttttgcgtgttttatgatgatgcctgcatatttgaagagaaagccactcttccagcttctgctggtgttattagtgttggacctctactacttgatattgggacttaatcactgccctgccattgtttcccagtctagggaacacttatagtgagcactggaacttaaacactggactagaactaaattgctactctactattgtttcctggtctgggaaagacttaaatacgtactggaacttaatttccaaaggaacttaatttccaaactcagttgtttccaggtcaggggaagactccacatgagcacctgagctttgtgggaagtctggccagagattcagaccttcctgccgatcatgcttcctgcagcactatagtgctggccggtctcctcagtatgacatctgcatccctgctgattggagctccaagattccagcaccaagtgatcagcacccccactttttgtccccagttcaccccaggtagttcagccctcctagctctcccaggggttcctgtgcagtgagacctgagtgggcttcccatgaagattcccatactggtagggggatcaaacatccacctccaattccatcttcccaccttagaaaccatgagtctgtgtcaattctctgtgagtggcattatacaagcctggagaagagagtggcacagtctgaaatgaccatttttcttagttattatggcctagtgggtttctccacttctccccaagttctggtgaattcatggtggtattcttgtcttttaatagtttccagttgtatgtttgtggaggaaataatgtcagggtgtcttctattctgcaatcttgctcatgtttctccttcataattactgttactttttatagaattgtatttagatctattggtcagcagatttgattataagaaattttgacctatttacatcatgagaacaaagaaaaattttgagaaatgatagggagaattcctcagatcaaggacttgtgaaagatcctgagaactgttgaccagacagaaacatggtatcagaataactctcttgtatcacaaaatttttttttaaatgtacttctttatctcaaattttaattttttaaaatatacatttgattgtttttttcttctagtataagcagatcctcactgcatgttttggggtgtgaaattcgacatctctagcaggttaacctcttgtattatgtcagagtggggaataagctcagaaaaatataatttatggagaacattttctcattttctgggaccttgtaaagaccttatttgttccaggtgacaggccccaagtggaataaaaggccattattgtgagaaatgacaactcagatatagcaaagttgttgccaggagttgatgatgcagaaacaatttattttgggcaagatggtattgaatggggagtctattagtggtattttaccatgtgaatttctatatgaaccatgtctgtgggagcactgctgcattcatttgtgggatgtactgctttttgctagttgccgtcaataaaatctgttctgtagctcttcaaagtggttgattcagccactctgtattcaggccataaagatcatgaaatgaaagtcttctgagctccaattagagtggaatgttatatctcaatgcagaagtcttcttcagtaaagtaagtgtaagtataaatttgtttagtgaaaagtaccttttggaaattgtacttttgagacagaggcattcaaactctgactaccgcttgccaggtgggtaatttaggggatactgcttaacttttttgataattgtatttcctcatctttaaaataaaaataatgatgaaaatgttaattaaaaggatgatgatgatattgacaataatggcaatgatgatcatgacagtgaagatggcaataacagtaacaatgaatctggtgatgatgatgacaatctcaaacaactgttgtaaggataggacgtaatccattcaaagtaaccagcacagaccctggcccactaaagggagatcattaaatttcagctgcccttaactgctttctcaaacctctactctgttttctggattttctttatttgtgtatatgtatcagttttatattgctgctgtcacaaattatcacaaacgtagtggcttaaaacaacatacatttattctcttgcaactctgaaggacagaagtacaaaatcactttcactggatgaaaatcagtgtgtcagtaggaccatgtcctttcagagtctgtagaagagaacccattcccttggcttctccagccctacagtggtgctcctcatattccttggctcctgacccctttctccatctttaaacaaattcattaaagttgcaggatacaaaaatcaacatacaaaaattagttgcatgtctatgagctacaccaataatgagctaccagaaaaagaaattgggaaatgagctgcatagtgaagtaatcagaaatcaattcactgtccttagttctgctgggacctcctgttcaggatttggcagtaccagtgacaaaggctaaagctgcttggaattatatattctccatcttaaaatgccaaggttaccttggacttcaacctcagatgtcgcatgtgactgtctaggttgtacataaagatacgaagggtgcccattgaagttggccagtgcacaacttgtgtggctgtacgtggtgggctttttctgatgcccaccagactaaaaactctagaaatgtgtgatctctatctatcttgtattctcagcacctactgcagttcttggcatacagtagaaattctcatttaaggaaatgaaggaatgaacatataggaatagtcaatacaagaacactaagtaacacctcatctggagttactcaggtcagtatactgagctgctcattcgaatcacctggtggaaattttaaaaaataaaaatctcagcccagatcctattgacagacattctgatttatttcatctggatggggctgcagtattactgcttttctaagaagtatccaggtgaatctaccgtgcagccaggtagctagaacctgctagtctggaagagtggttctcagacttcatgcattaaatttacccagtggacttgttaaacacacaggtgacttttcttactctgtcactctgagtttgggggctgagatattgcatttctagtaatcactcaggtaaggctgatgttgttggtatggggaaccatggtttgagaactgctattcaggaagacagcagagaagataagttcctttagtgtgcataggtggaaaacagttggtagagtgattctggaagagtgcatgcatgtgcattcacatgttttattaacatgtgaatatgaaagatattaagcacccatttgtccattttaaatatataattgtatcccttctgtccaacagcatttcactgtagacatttttaagtgtcagttttttagctgaaaaactagaaaaccaaggaagtaaatcattgcccaagctagacttgatcttttcagcatgtcagagtctcatgctttagaaaaccagagaccactctcactattttgtgttcatcctctttctccatttccagtcactttttctgcactgacttcaggttaatcttccataagagggccttggtgttctcatcttattcctatgcccccactaaattctgagtaagtgtaacagcctttgtccttctgcatgccacacagtagttacctagctaagatattgtcaatcagtttgagagactataagctgcctaacctagagttggaggataataccaatctgagatcttctgagcttagcatcattatcaacttctgttacttccactaaaacctttgtaaatcacagcagatatatttcagaactgtgccacttatctcagtgcctccaggcatttcaaagtagtcacttcacacttgccatcctccctgtccttctgagtcctcctctcagccccagtgtgtctaccacctcaaagcctatggttgttagcctgccttacttgggtcaaagaccttgactccttccagatggatcctaaacttcccttccattcactttatccaaaatgaaattgtacattcttgaaatacacagcagcactcaacaaatgctgaaaattatatgattaaagtaatttgcactcaaatgtaaataaggcttgatgctccatggaagttttgaattttaaagaagagctttttattcccaatggctctaatgtgtgggaaacatattgggggaggaggcacatggggtcagcaaatgctgtggacaattctctgccctctttacctgggctgccgttagtttgtctggcagggactgaatatatggctttaatattctggccaaactatctcctcatctccccttagctttgcaaagtggctgcagtaaaacctgccatgcttggattggcacggctcaaagctaactgtatttgaaacttcacatttcaaatctcgaagaagacttctgtattaaatttagagttttttatcctcaaaggagttgtacattttatttgtgtcaaaatttacagagcactgtcttaggcgctttctagcagttgctttaaagggttgtcagctccaggcatttcctctgcccacatacaggtgttgtcacatgttcccaggtgaggagttagcaagggtttgctgtagctcttggtttaaatgttggcaaaaaaaaaaaaaaaaaaaaaaaaaaaaaaaattacacctgcatcatctagaggtggcctttcccaatggacatttccacttgtgatgatggactgaatattgaaaatcatttctggaaactgtaaagtgaaagaagccactgacactgaactgcctgccagaatcaggagataatttcttttctgggggaaaaaaaaaaaaaaactaattctctaagttttaactgatttcgggaagttaaaactacagtttatccccagggttatgggccaaactgtacttttaaaaaaattatatgttgaattcctaacccccagtacctcgggatgtgactggatttggagatagagtctttaacgaggtgatgaagttaaaataatgtcattaagtttggctctaatgcagtctgactggcatccttataagaagaggagattaggacaaagactcacacagagggatagccctgtgaagacacaggaaagagagaggccccaggaagagccaatcctgcagacaacttggtcctggacttctagcatctaggactgtgagaactaaatttcagttgtttaagccactcatctgtagtgctttgttatggcagccccagcaacaagaaagttgttgtcaaagaatacatccttttgctggaccagcctctctggggctgccccttccctgagcaggtggatttctctgtccgactcctcaagggcatggcccccacctccccccagcattgctgcagacagtgctcctgccattgtcctcttgtcgcctgtctaggtttggttgtccttgttctttcctctttgcctatggctgaaattaagaatggtgacaagataagactataatcctctcctttagtctcagtacaaataataccacattaaaatctggagaaaaggaacatgatgatccatgggaaggacagccagctctgtaaaagcatcactggacgctagcagaaatggtgcactccccaccagaactcatgctcccccttcttcctgcagggttggagctgggaagcagctgcccagacacaggctgtggtttccatccctctccttgttggggattgtccgtgtgactcgcccctgctgagggatggcgagttgaagtgatgcaccttccaagccttggtagtgaagcaggaagtgtgtttctctgcattctctgctatctggttctaggactttgcttctccaagtgtggtcccctgactggcagcatcaacgtcactcgatgatttgtgagatgcgcaaaacctggggcccattcctgacctactgaatcagattctctggggtggggccccgcaatctgtctttgaacaatcactctaggtgattctaattgacctccactttgaaaaacactgggatagaggacatgagaggtctccaaaaggcaagaaccaaggttcctgaattgttgtgtagaggaagggcacccaccaatcatgaacactactggggtgaccttcatgtgactcctaagcaagatgtaaatgcctgttagcttggaccactgaaattctggggtttatttgttacaacagttaggattgtccttaatgaagggcagaagaagatgcgattacaattaagtggttacagaaccagctctgggtccctgatgcaactctttcccactgtttgctttaggaaaagagcaagagttagaatttcatgcattggcatggtctacctgcaacctgttgtgcattttaatttaatttagtttcttggtaaaatttttaaaaccttatttggtaacctctcaaaagcaagaaactaattgttcttctgatgtaaaatatcaagcaaatacaatcaactattgctacttacggggagggggtacataacagagcagacccttctctttgccaagactgtcgtgaaatgcatttcacatgaatgaaacatatgcctcccactagtaggagccacagcatcccttgaaggctatcactcccctgaaatgagagctacctctcagactaaagtgtggtcagaaagggagacttgaatgggaggatcattttattgactgtgccttcagaaaaagaaggtggtttctgcatgacaggaggtaaggctgcacctcaccttgatatgggctggaagactgggagcccagaacccactcaagagccccttctgaggtcagctggatgctggatgtggccaggctctggaaagccagcagagaatgagatgctctttctgcctgcggagattgtgttcctctccctgtggcttagtgtcatcagccctataatcacctgatagtcatgacacatgaacccagacaggttgctgagtgtttttgagatggagttttgctcttttgcctaggctggagttaagtggtgcaatctcggctcactgcaacctttgcccccttggttcaagtgattctcctgcctcagcctcccgagtagctgggattataggcacctgccactatgcccagctaatttttgtattttttttagtagagatggggattcaccatgttggccaggctggtatcaaactcctgacctcaggtgatccacctgcttcggcctcctaaaatgctggcattacaggcgtgagccactgtccggccggttgctgagtttttaaaagcaaacctctccagtaactgggtaaaatgttgatgtatttccttataaagctgtgtgtctctattttttatatatatacacttgtgatcctataatatgtatcatttctgccttacagtgaaattaaagcctgccttttattttataaccaagagtcagaattcaagaaattcactagtaaagcaatccattagtaaaaataagaaattagaataaaggaaaatattgtctattgtcctaactcccataattctagaatcttccttacagtatttgttccgtagcatcaacttgctttctgattgaaatcactgtgtgactgtaattttgctttctgcttaacattttatcttaagtattttctatagtgtttcacggtctttttaaatgtaatttttgatccataatattccataaaactaaagttccacaataaactatcttcttcttgtggagtagttatataattttcaattctataagggtttttaagtaaaattaaaaagaataacttggtgcaaaaaaaaccctatgctatttaagattgtaacttcagtatatgttatagaagaaagaagcttgggcttgacaatctgtgacatcatagaaagatatttggtctttgtccctggttcttgacacaggagctcctaaaacccttgagatgtcctgaatgacaagtgtgaaggaagcctcttttgttctaatgaggtggttggaggccctagataccttcaggatggggggctgcacaccaaaaagaccaagtcacagtgacagggttggtcacaattggggaagcctcagaagaaatcaaccctgtggatactgtgatcttgaacttctaacctccagaaccatgacaagatacatttctgttgtttgagctgcccagcctgtgatatttcgttacagccctagcaaactaatatacccacggcccccatgagcttaccccctgacttttggagagagaagaggagctggaagttgagttcagttaccaatggccaatgatgtcatcaatcaagcctatgtaatagaaccaccagaaagccccctaaatgatgggcttcagaggagagctcctgggtgggtaaatatccttgagtgaagagagggtgatgcgtccagggagggagtaggggctctgtgtccctttccccataccttgccctatgcatctctcctcacatttggctatttctgagttacatcctttatttgaaactgataatactaagtaaagtgatttcctgagttttgtgagcagttctagcaaattatgaaaactgaaaggggagattcataggttccccttgactttgtattcaagttggactgaagtgtgggtagcctggggatgagctacttgcacctggcatcagaagtgagggcaatctcggggaatggagcccttaagctgggggtggggaagtctgcactacctctgggtagtgagtgtcagaactgatctgaaatgtaggatatgcatttgctcttccagagagaattggttggtgtgagaaaaaagtctgcccatttggtatcagaaatgctgtaaataaaaaatagtgcagaatgcaacagatttgggtttgaatcatgactctgtcactttctagccatgtggcctttgtgatctttcatacattagttaatatctgtcctccttcttaaaataggactaatctctaccctataaggtgctggtggttgttctttgagggctaaaggatgcaatgacatttcaaatctcttagcacagtgtgtctggaatgtaggtgggtactgcacaaatggtaaatatttgtattacaaaataggcccccaaaagtggaaatactgggcaagagtttgcagcctttttttgggatcttgacacctatagccaacttgctttctaaaacatgcacacactcatttcagatgaaagcaagtgtgttttaaacactgtggcagtttgtaacagttccttaattgctgtaaattgtatacgttccttaactagttgtatttcctccttgctacttgcctgctcatgtatcttttgaatggaatttaattcagtaaacacaaatagtcatctagcttgtatcagtgccgtactaggtgttagaaatgcaagcataataggatgcagtacttacccatttggaactttaaatcaactggaggagaaaaacacgtggatcagtaccctcagtgtgatacatgcaaataacatatatgtacaggcaaagagaacagagagtaatgaattcctttgctaatttatctctcaatgctttagcaattttttaaaaattcatttgtgaatagttgaccagtttaaatattgaaccaaccagcatttctgttttgtgacaataacaagtcaaaatccaagattctcttcttactttgtctactctcttctcttccaaaagcacattcacgtttgtctacataaatacatgagaacattcagaacccaagaaggtggactgacaaagctgagggacggtagagactgcacgtattaaacaagcaggaaaacaaccctcagagtctacattttcatacaacattagaaggaaaaaagggtattaactgaaaagaagggtgtggaaatcaagtgtgaacgagccatattgaaactctggctggaatggtgggatggaggtcccagttgaatttttcctaagaggctgcttggtaaacattatctgtagacctctccgacaattggatttacattcgaagaagcagattgaggctcaccctgatagaagaaagtgcagtgatttacacaggttggatggaagacctttctgtcctttgtgtatgcatggcttgactctaagctctggcccctttgtctcttaaagaggcctttctcaaggtggctcttgaatatttttaaaagtatttttcaaggctccctgcatccaagcatggcacccatgtgctgtgggtccttctctccctctggcccatgagtgacttatctgagagatgggtttgggaagaggaagcagcgtgccccttttcttatcttcctcctgctctcctcttgtagccccgtagcttgatctctgtagatgctgttaaagtggaaagcttcaggtgaaaatttccttggattggagactctcagtgtcatcttttgacaacatttagcgtttcttggggtgactccgatttctagatgaccccacatcgcatctaatgcacatctaagttaatcctcacagggcttactctgcttatcatttattaaggactgacatttgtataattaagttagggcccatcatctgtttaagattcaacagtaagtgatgtcggggtttacggatgccaagacaccccagctccctgcctatatttggaatcaattaacagaaagatatagagaggggtcaggtggagatcaaatatcatctgtttatgacaaagtctgagcttgacaatgtggtgctgacgggtggcagcaatggccttgctaatcctaaaccccagaaccaaaccaagccaggcccctggagcccttcccccaaccacaagcagggtcttgctgcaacttaacatggggagagtggagcagagcagagcagtgggcatggcccctgaggtcaaggaggctagaggggagaagaaaaggaggcgtgtcactttctcttcccaaactcacctctctgataagtcactcatgggccagagggagagcaggacccacagtctatgggtgccatgctcagaggcaaggtttctcagcagcggcctattgacattttgggttggatggttcttcaatgggagggactgtcccacacacagtgggatgtttggccacatccctggcctctactcattagatggcatagcactccccaaaccctccctcatgacaatcaacagtatctccaaacattgctaattttccctagggagggcaaaattacccccagtggagtaattccgcttctccaatgtgaggtctcaccaaaaagtagactgggagtagggaattgaaaccgcaaaagaaactgcaggcagcaacctcctcagtcccatcagtcagtatccagcaggctcctctgttctttccaagctcctggttcatacctcccctggcacttgtctccagcctgcctccctgtaagtgcctctccagtgggttatttacgagtgcagcaactacctggccttttgcccctccagcacctgcatgcatgtctgcaccctcccagtgcctggcacagtttgccatacctggggcctcttttgtataggtcaggaaggtaatgattttagagaaagtttctcagatacaggaagaaaaaaatagatgagagtattttcccatattaatctttaactgtcgctgtaattgcctcaaatcactttatgcatcgtctgacctgccaatcacatggatcttacccagcatagaaaagcagagactctgaaatagtagaaaaaatagcaagtgatcatcatatccgtggtgctggctccaagcccaggactcgcacaaagtaccattaaatggtgataatagtcacatatattgctttcttcacattttaagtcctctcaaaaagtgtttcatattcatcatttgtatgcatttgtcttggattcaggctagacttttctagttttatgatacaagtagctaattaggactagtataggggcaaaagtaacttattttgcaaagcatgctcacttgaaattgcctcaataattgtatgagctattttaggaatcagagctaatgtgtgattaattagaggaccttgtccacatcagtcaggcaaggagcctccaaggagatgaagttattgaatcagtgtatctcctctaaggcagagaaacatgcattcttcttgtgatttcatgactcttaattggaatgagtaagagactagatattgctgagtcaaccttcaaggttcttggcatctccaatacaccattctccttgaaaacatttcagtatgttcaatgttgggcagttctaattgttagaatgttctgccttacatggtggtggcatctgcctctctttaacttcattcttaaaggaagggagggtcctagggtgatataatagatttcatcctcctgcccacagcagtcattgcagaatcttcagaattctatcacatttgtcccatattatggtccctggttcctctaccatccttgtttccctctgttaggggttgaatggtatcccccaaaaactatgttgaagccttaaccactgacctcagaaggtgattgtatgtggagatggggcttttaaagaggtaattaagcaggcctggtgtggtggctcctgcctgtaatcccagcactttaggaggccaaagcaggtggatcatgaggtcaggagtttgagaccagccgggccaacgtgataaaaccctgtctctactaaaaatacaaaaaattagccagatgtggtgcacacctgtaatcccatctgctcaggaggctgaggcaggagaatcacttgaacccgggaggcagaggttgcagtgagctgagatcgcaccattgcactccagcctgggtgaaagagcaagactctcacccggggggcgggggggggggtgcagtgggaaggaggtaattaagttaaaatgtggcctgtaagatgggccttcattaaatatgactgatatccttataagaagaggaaattaggacacacacacaaaggggaatgtgaacatacattgagaagacactttctacaaaccaaggagagaagcctcagaacaaaccaaccctgtggatactgcaaacttgaacttctaacctccagaaccatgaaaaaaaatatttctgttgtttaagccacctggcttatggtattttgttacagaagccctagcaaactagtatactcaccgccccatgagctatagcctcaactttcccctccttatcatgaggaccatgattgcaactgccttgtgggttgatggggaattccatgagatcatgcagtgtctgtcctggtatttagtgaaattgtcttcttgttaacattattctcactatcactcctatcatactacctgtgtttaagtgactaatgaaaacattaaatacaacaaagttaatactagcctaattttgtgttacttcagaatctgtaaggttgactttgacccattcctaaatacttcttcagaacagtcatgcttatggctcacatccttattaccaaaccttccttaccgaagctcatatttgttgcctctgacattctagtttactggcctcatactttaaaagtatgagagaaacaataaatatgtaaattattttgtttttaaatgcatagagttggtccaaatatgcaaacataaaaataggtctttaggtagtgacttggggtcataggtttactttctatgggctaaacatttttctgatggtaacaggatcattccataatattttgtaacaatttctgttttgggctttagtaatcattgagcaagttgcatgtgctatattgttaacattgtactctaggtgccccaaaatatgcaaatactctaaatctactgatttgaaatctggggtattgtgagtccggggtcttgctcccaccccctcctctcttgcagtttgtgttgccttggcaacagtcttccagcacatcacatcaggtggcctcttatagagacagcatcatgggctggacagcgtgccaggcttgtggccctggggcatccttgatagatgctatgggcgttattttctgcttataaaatcttagaacagttatgtctttacagataagatttgatttttatcaaacggtggaaaatgctgtgactggcacggtcttcacactctctcttggaaatctgcgatcctgggtcggtttaatttaaaacattccagtaataactttcagactttacaactcaattttattttgagaagtcatcatgaaggaaatatttaagaagtctcattcctttaagtttaaaaatgttccacaggattcatttgcaacagccagccactcaccccaaccccaaacttccagaaaaaattatgcctccaggacatttctccaaatgaagtgtcaagtccaaatcaagtcaaatttccaatgtggaataatggactctattttatgacctcctgcgccccggaggctcttcggagcccattacacagctggtgcatattaggtatagaaggaaagagacctgagtggctacgggtttctgctcggtgaagcccaagccacatttcataggttctgggattattaatggtatgtctagttgccttgagaatgttcaactccagtctgttatgaatacttaatagcaaggagaatgtgattcttctcttttcagagacgtttctgtgactcggcgaattcattctagtgtgataggcaaactgtcaaaattaatgaattccaactgagatttggttgtagtgcagttgtaaattagcattaataccacagtgtatgttgaatgtgctacattttcaccatggatctggcctagaggatgtctttggaggaagccactctaaaaatcatgttttctggtttggttttttcaatttttgatcatagttttaattctggaagaagtatatgaaagtaggtcattaagattttatagaacacaacaaaaaaagaaacaggaaataaatgttataaccaaagacatgttagcagagttgtcttgtttttgtgtggctgtgacttaaagatctgattactgaacctcaatctatctaaatgttaagtgattacaaaggaacacgattcagtttataaggctttagatgagctccaaggactacacggcatacctagcccaagcacatcttattatgagaattttaaataatctgcagcaatgtttagatcaaaggtgttttaagtggggatttggacctttaaggagctggaaacagaactgtgtgtgtcctttttgttcatgacagagtgcagcactttcttctcattcttaaagggttctgagcccaaacacagtcactgcttaactgacaacctagcaccaaatcccagctctgttcctcacgacagagttcaaagtttatatggtttctcatctctgacataaaaatagcagcaatagcagcctgtgaggtgtagtttgaggattaaaataaggttttgtatttagattacttagcataatcctagcacataatgtgtattccataaaagctaattatttaatcatgccaagaacagaagcaatagttacagctttgaatataaagtttgataatgcacttggtgatattttcttggcagacacggggctagcgacccatgtcagtggagattgaaatattgccacgtgtagatgcattaccactgagtgaaggagcacacttgggcatcttggtgctttgctgacacacaatacggaatccagggtaactaatttccttctcttctctagagctctgacttctcacctagtgcagtctgtaagaataaacatctataggattaaatgtgacaatgatgggtgaaaatgcttgggaagggcctaaggtgctgtgcaaatggagaggcggcattcagaatcatttgtagtgggctaggcatggtggctcatgcctgtaatcccagcactttgggaggctgaggcaggtggatcacctgaggtcaggagttcgagaccagcctggccaacatgataaaaccccgtctctactaaaaatacaaaaaattagccgggcgtggttgtaggtgcctgtaatcccagctactcaggaggctgaggcaggagatttgcttgaacccgggagacggaggttgcagtgagtcaagattgcaccactgccctccagcctgggcaacaagagcaaaagttgtctcaaaataaaaaaaaaaaagaatcatttatagtgaatgtttaattttaaaacactatatgtcactgagacttattgatatttaattgaatttagcctaacagtcttgtgttcaagaagtattaaatatttgttgagactctttgctacatgctagaaactattgtaggaattgggaatacatcagggaataaaatcaaccaaaatatttactttttagggaccaaaattttaggataggtttagaggcagacagttgaagcaagtataacaaataggtaaatgatcgagtgcactaaagacgctgagggccatggggagtaagtgcaggcgtgggtcggagggggcgctgcagtagtggaagtgccgccatctttaccaggcagtcaggggaagcatccctgagggggagacggcacagccaaggctggaaaaggtgagccagggagtttctgggagaaaaacatcccaggtggagggagagcaggtacagagacccagaggtgggagcctgcaggggtggtctagagacgacaaggaggccagtgtggctgcggtgggatccccaggggagggtggtaggagatgacatcagagaagaaacagtgaggatggatcctgtaggaagataggcttttacctggagaatggggtcctcaaaagctcagaacagaggccagagatggcctgagccatcttaactggatcactctcactgatggagctgatggatgagagtgtgtgtgtaggggaccagggtagaagcagagagacccattgggcaccagggagaggtgatggtggattggaccagggagtggcagaggagatggcacaaggcagatgcagggtatattttgagggtacagctaagagacttattgatgctgtgaatataagatatgaggaaaacagggacctctacaagcacccacatgtttgggttgggcaactgttaagaatgatgctttttacttcttcgattaaaactctcatattttaaggatatttttgagtataccttatgtgactcttattaatttttttctgaagtactaacaaatgtgcagaagaatcacatacatgaggaggaaggcaagaaaacttcttgaagttttaagaatactggatcccagaacaggggcatagctaagtggacaaggaaattaggacaataatttaaccagggttccaatcaacagattttttaaagtcttgcgtgtttgagactcctaaataagcctctgtaggcgagatttcagcatcgtgtgttttccatcattgagagcctgtggggcgtcattagtctccagctgactgatgtaggtgagaatgtcttattttgttttttgttgtttgtaacagaatgcctgacactggtattatagagaaatgatatattgatttcctccaattatggaggctaagaagtccaaggttgaagggccacatttggtgagggtctttttgctgatggggactcagagaagagggggctgggtatgccagctcagatctctcctcctcttcttataaagtcaccagtcccacttccatgacaacccacccactaatcaattaatccattactccatcaatccattcatggattgatctattcatgagggcagagcctacatgacccaataacctcttaaaggctctacccctcaatactgccacattggggattaaatttcaacatgagttcgagtgggggcaaacattcaaaccatagcagagaatcagacaaattgtgctgcgtccacttggaaggcactgttccgcatagggttggtttgggctccttctgatcatgattggaattagacaaactctctggaaacacactcacttacagactttgctttctgtgagtatttttttttttcctgttaaagctgactcttctatgttcagacccatatttttaagttatctttttacactgaaattcttaatctttcaagtttagatatggatttaccttgattttatggactgtgaatgccctcttttcttatctttttctattttatctatataatgatactaccatttggggttagatcaatatttatgatttacattattatgactatgtaaatattagctacagctgagccacatagtatatgatgaacactttttctattacagctttgtgtttttcctaggattaataatcacttgcttctttgtttacttagttttcactgcatgtgttactaattcattccccaaattctccaacggactaaacactcttcttaatacattcagatgcattagcgtgcttgaatgtttatttttttcctggaaacatctctccaggagccttctttctgctttaatctggactgatttctgctgtatgtttgttgttctgttatcgttcacagttattctggaaattctttttgtttctcacctatgttgtaccgtctgttttctggatatcgtatgttctttctgagtttgcaaccttttaattcattttttaattgctttttgaagaagggtacatgagaggtcaaaattttgactttgcatgatctaaaattgtcctcgtttacttgtttgatactttgagtatggaattctaggtcagtcacaccttgctttataaatggctgcacactgaggtccagaaaaggcaggcccttggtctccacactcctaggtcagaacctgagagcaggttccaactacagagaaccccagaaatgatggcaccttttctcacaaagaaatgctttttccacctccacagaggtctgccttcggttacatttaagtgttgattgcattgtccatacactcagtgctgtgtgagcacacggtttacaaggatgacaatgccccctttgctgcattcaaggtacaaatgttttggcaatgaataaagtcacatatacgaacagtctgttgatatgcaagggcaaaaatacagaactggatcaggtggtatgagtacaagggatggtaaagtcaggtgagtttcattcatgcagtattccccaatgtcctctgggaagatagaagagtacctcatacctggagcccggacgcaggtttttttttccatcactgctttggcgacagtaggcattgctgataagaaaaggcaactggacatctacactttgtcattgcttcctcatcctgccacagaagcttcattaacatggaaataaagggatttacaaacactctaaggacaaaggggaagagagatgagatgctggcagtcatgagatgccaatggcaatggatttaacattgtggagaaagccaaaagaagtcatactagaggaagccagtgagccagtctctcattcagagcaaaccctggaaaggctggtaaattcgagggaccagattagactggagtcaatccttaaagagtctttcaaagtttttttaaaaattgtcatcactcatgacttagggtgtatttgcatttatgagaatggtcatttattttgtttctgaaacttaaacctgtgcgttacatgaagaaagaaattacttaaaacattagatttctgtaagtccttaggtcagagcaaaatgaaaaatgaagcacttctgaacatagtgaagttctagcaaaagaaaataatgctcaacagtgtattagtcaatgaaactaagaagaatttatgtctttttgtcatttcacttcagtgttttcacttaatgctggagtgaaaggtttaattaccgaacttggattttacatttttatgctgaggtaccagtcagtctctggttataattcattttcttctttaatcataggagaaatgattcagttggctttggttaacgtcctcctccccttccctttgataatcttactttattgttgcttcactgtttttttgttgctatttcacattgccatgtttttggacattcaattttgtaattttttccctctctctccaactctttgcctcttaatctgcagaaagcaattctgttaacattattgtgatgttatctttatttctctgttatttctgctgattttcttcatttgtaattctttacataactctgtactctttcttcattcgtttgttctattcttgttccccagtttttatgcttccgaatcctaaggagccatttacatcattttggtttattcatgtgctttactgcctgtgatcataatgctcactgggtcttctgctccttccaaatcgctagccactttcatgccttttgaaacctttgagcttaaaatgtaaatgccggaacgtagtaaaccacatacatattattcattacagattctatattcctctctgaaaatgtacacttaacccctagcaatgttaatgagagtgactttaatccatccaaagggatggagagacttttatctctaaaatgaattccctatacacatatggaagtagtactctagaaatggattgcaaacaatactcagacattttctgggtaaaacactaatttatttttactttttttctccagagctttgtaaaacccatggcaaaaatcaggctttttccttcttgttgcaaaataagtacaaatattggataaaaagaacattcttacacaaagtagctaaaatcttcgaagtgtgttcttatagcacctcagaaattctttttgtcagccactcatccttgtggtcccttgatatctatataatggaatttagattatagtagatgatgtatataaaatacagattgttacttcttaaaaggaatctctttagttatatgtagtatgaaaaccataatatttttcttttaaacatttatttatgcattcaataaaaaatgtgagggcttctattatgtattagccagcacaccagctgcctctaagaataagattgcatcatctcctatgaagcatgctgcccctcttctagattgcaatggagtggggtgcacatgcaaaatagctatgaaaacattgatgacagtgtgatgcaagaagctgaaaggtaggacacggtgtctagtatgaaaggtagaagaccgggaataaattctaaggaattggtgtttagctgacattcaatgaatgagtaggagttaattggataaaggagggtgaagtgttccagctaagagcctagtaccagcacagaccccgagttggaaggggattggggacctaggacactgaggagaccagcgtggccagaccctagtgtatgacagctgtgagatgacattggattttttctactcacagtttcttaacctccaacattcaagaatgcaacctacatctcaacaaaaaacactgttacgttaccctaatggtaattagcactaaaaaaaaaaaaaaagagcgagagagacccagctctcagttctccttttggattttatatttttcactttaattccagcagatttgcttcatgtcctctgaagctcttttattaggtacatagacatttaggattgttatgtcaccttgatgaattgaccactttatcattagggaataaccatctgtccctagtaatatttcttattctaaaatctactttgatattaatataatcactcccactttctttagagtagtgttagcttatattttttctattttttttacttttggtctatcagtttctttataatagaatttctcctggatagcgtatagttaggtatttattttttattcaatctgacaatgttttacttttaagagtgtttaggcaatttatatttaatgtgatggtcaatttggtttcgtttaaacctatcatcttgctaattgctccctattttttctatctgtcctctgttcctttatttttctctttcttgccttcttttggattaatggagtattttttaaattgtcaattttacctgcattaaaggattaacatgtaagttttgtttttattttgctttgtaagtggttgcttttagagtttacaatgtccatcttcaaagtaacatggcttactttcaaataataccacttaatttatagaaggaccttacaacaataaatttttatttcctccttcctcctgcctttgtgttaatattgttattcattttatctatatgttacaaaccacacaatgcattattattgccttaacagtaatgtatcttttgatgatttaaagtgagaaaatatgattttatattcacccacatgcttaacatttttgtcactcttcatttctttatgaagtcacaaatttgcatctgatattatttcttttcttcctgaaagattttaacgatttttgtattgctagtctactgacaatgaattctcagctttggaatgtctagaaagttattttgtctttatgaaaatttttctgcatatagagctttaggttgacagtttttctttcctgtcttttttttaaaaaaatgcttcaaatttctctccccttgtcttctgttttgcgttgtttctgatgagaagtctgctgtcattcttatctttgtttctctaaatataacatgtatttattttttaatctggttgcctttaagtttttttctttatgttggatttgaacaatttaatcatgtgtcatgttgtggttttctacatgcttctgtttggtgtttgttgaatttgatggatagttgaggttctagtgttcattaaagtttgaaacttctgtatattaattgttcgattttttttctgtatctcattttcatcctagaactccaattatacgtatattaggccaaacgatattggcccacatctcaccagttttgtgtttactgtttttaagcctttttaaagtttgtttttcaatttgggtagttttaattgctctgttttctggttcattgacagtttcttctgaagggtgtaatctgccattaatcctatttgtctaactttcatttcatatattacattttgaatctctagaaggtccatttgactgttttatttgcagcttggctgtttgtattttctccatttctctcatcaatgagctcttcctttttcctactgtcttgtacatattgacagaatatttataagagtgatgttaatatccatgcttgcaaattgtatcatctctcatttatgtgtctttctgtggaatagtttactcctaataatatgccatatttcccttattgtgtccaattttttattgaatgacagacattgtaaattttatattattgattgattgttggtttctattaattatcatcaaagttttttgttgtgcagttcaattacttagactcagtttgttcccttctaggatcacttttaaattttgttatgattaatttgtcccctgcagctgtgtgatacatttctgaatactcaatctgatgttctatttattagaagttcttacctcttttgctggttgaaacatgaactattttctcccctgtgtgagcttcacagattttcacccacttctttctggtgttcctaatccaaccttggtagttttcttacacgcatgcaaatatcagcacacagttaaggactcatcaactggaagctccttccgctctctggagctccctctctatataacttccttctttccactttgtaaattctagcagccttagtcccctcaagtgtcatacttggtccccctaaccccacaatataaccaagttttattcaaatttcctccttttggaattatcttagaaactcaggaagtaagctgggccactcataaggtccactttgtttgtttccttctttcattttttttttttctgtactgtctgaaactttagtgaagacatagagtaaatccagttcttgtttctgtgtttttgtttgttgttttatgatggacagagacagaatttcatatttctaagtgatgacagttgcaacatcatttcacagcttgggagtagatagaatgagtgaaatatattaacgttaaaggcaaaattgctataacatatgagcacattttaataacctgacttggaatcacttcatagaagccttggaatgctttccaagtcattataagcccatcatttaactgatttgtgattgtctgatcgagatgacactgaatttctaagcatttatccaaagaaaaaaccattttggagtctcagaatcagctaaatgttatgctttctagatatgtttacctaaggctaagttatattccctttcattttggaagacctttacacaagcagttcattttagtaagcatacccactcacgtattcctatgaaatcaataaagctaacttgaacccaaatggcatttccattcaaaattaatgtacccaatttgcaaattcgatagcctgttttagttctcatgttttctgacctctctgaagcaattgacagtgttgaaaactgttggttaacgtctcaaaatgtctttttgtttctaagacatcactctctagggtttgagctactgatctcctaatttcctatttatctccttcatgatttttttccaatttctttaaactcttttaattttttaattgaaatgttacatacatgcaaatcactgtgtacacatgcagtgtgcccagcacccagatcaagaaaaagaacatagcctgcaccttggatgccacctcatggccctttccattctctgcacctgaccccacccccacgggcaaactttattctgactctcaacatcatagattagtttttcctattttgatgtttgatataaatggaacaatacagtgtaaatccctttggtgtctttttgcttttcttcaccattatagttgtgtgatttataatattttatgtgcagattgttcattgttatcagtatgtagtgattcaaggtgccaatatatcacgatgtatcaattttattattgatcgatatttggtaagttttcagtttgtgactgttacaacgtgttgctgctgtagatattccagcgtgtattttttgatggacatatgcatgtgcttttgttgtataaatacttaggagtgaaattgttgagtcacagtgtacacatgtgttccctttagtagaggctaataattttccacaataactactgatttacattactacctgcattgtttgagggtcttgttgctccacattcttaagaccctcaatatattctgtcttttccattgtagttattttggtggatgtgtagtagtaccccactgtacttttaatttactttttcttaatgaccagtggcattgaagcactttttaatgtgcttattggccatttatatattggcctttgtgaagtgactgttcacaccttgtgtgtgtgtgtgtgtgtttttcttctttggagacaaggtctcactgtgtcgctcaggctggagtgcagtggtgcgatctcggctcactgcaacttccaattctggggctcaagtgatcctcctacccctgcctcctgagtagctgggactacaggagcatgccaccacacccagctaatttttggtagagagagtcttgctatgttccccaggctgatcttgaattcctgggctcaagcgagccacacacctcggcctccaaaagtgctgggattacaggcatcagctactgcacccagcacttttgtccatttttgttggactatctttttatattggtgtgtaggagttcattatgtattttgggtacaaatcttttgtcagatattttcctaccttataaaatactccctatccctgaggatttacttctggtttttgtctcttcttgttctttacacttgatatgccttggctgtgccctcacccaaatctcatcttgaattcccacatgttttgggagggacccagtgggaggtaattgaatcgtgggggcaggtcattcccgtgctgttctcatgatagtaagtctcacgagatctgacggttgttagaagttttcctgcacaagttcactccctttacctgctgccaaccatgtaagacgtgacttgctcctccttgccttccaccaggattttgtggcttccctagccatgtggaactgtaagtccaattaaatacctttctcttgtaaattgcccagtcttgggtatgtctttattagcagtgtgaaaacaaactaatgcaacacttttcttggaatatctcacccagtgatagacttaaatttccctggctgccaaatatgtctctagggtcttggactcctatttccaatttgctattgggtggcccaggggcagtgccctctttacgttagtgaaactgacatgttgtttcctttaccaaccagctctgtcttgtaggctctctttgtaatagtgtaactgtgcaactgggtatgcaagcaattacatttgcctcctattgactttttttattttcttcactctttttgctcccacatccctgcccaccgatgctggtaggatcatatcagacatatccataattaggccttttttctcccttctcaccaccaatgcccagctggcctagactcccagcagagcagtctagccaggctttctgcctgcagtcttctctccctgtctactcagtgtttactttctcaaacttcaatttgggaaattgattgttcattgtcaaaactttcattgacttcctactttttaaaatagctttattcaaatataatttagataccataaaaagaatccacttaaagcatacagtttagtggtttttagtatattcacagataaggtgccttcaccacaatcaattttagcaggttttcatcacttcaaaagaaaccctcctatcctgtcccgttacccagtcctaaccataagtaagccactagtcgactttctgtctctacagatctccctcttctggacatttcatacgaatggagtcatacagtatgtggccttttgtggctgtaattgagggtcatccccattgtagcttgtgccagttcttcactctagtttattgctgagtgatatcccattgtaaggctaagccgcattttgcttacctgttcttcaggggatagacatgtaggctgtttccaccattggccattatacataatgctgctttaaacatttgctcacagttttgtgtggatgtatgttttcatttctcctgggtatgtgcctaattgtccttattgtctgcagggctaagcgcatgctttttagcttggcacctgacactctttacaatcttgactttataatcagcacccttccacgccttggttattagtgtgtctgctggtcttggcacagtgccagatacatggtaggtgctgaagagtgtttccaagataaatgaatctaagaaacctgtagctccctctcctaatcgtgcaacacttttagctgtgcattgaatttcctgcttcccagcacctttttatttctctcctgactgggacaactcaatgtcctaatattttttaagacttctgcctagaatgtacttttctttcctcctctggaaagttgtttccatttttcataggtcagattagtttctctatcacttatgcttctgttgcattttgtgaatgtttctgtcacaaccttcggtaaatagaattataattgacctcactatgtgaactagagtacccttcagactgaaatttccttggcagtagtaccaggacttgttatatcttgcattactgggcccttacacaagacctggtacctagtaggtgctcaataaatattattgcatcagtgaatgcttgtgtcactgcctactgcaaaattcctcccacatctccccttttcaccctgccctgtttgaattttaagaaaagctaaaatattgatttattttctttttggtgtaacactcttctttatgtttgtcagtggagccttggttatgccgtctgttacagggatgtaaaatattgagaagtctgcaactgaagaaacaattctccaaggtccctcccattagctcccttagtgttggtaccccaggattttcaaccctgaatttcacaagattgtgctgaatgtttcatttagctttctgttttgaacccacagttattttttaggaactttcacacacacacacacacacataattcacattaaggttgcctctgcccttactggaggaagcaaatgttactgtattaaagagcaggaggcactctataaaaagaagtgctattatttaggcagatggatggtcccttagatggaagaaacaaaagctgttggaatatagtttgggttttcttttgcctgtggccatatgatgtgtctcttagagaatgagtttatgttacattattaaaccctgtggcatgaaggagaaagactaatgtaaaattctttaaaaatataaggagaagtgacagtaatcccccataggtcgcttatctctttaactgctaggattaaacatttatttatcatttttttcctgcagtcatttaaataatttcacaagctggcttgtggaatgagattttcaataagaaactatacatttaattaagcaatgtttcttgtatacatttacatttttaaagtcttgctattcttaacaagactacttttaggatacaagaggataaattcaaatatgaccaaattttgcttagttcaaattacccacagtcgggttgatagaaaaataatgtagggaaaaaaaataaaagaatcctggtggaattaattagccttgaagagtgacagttacctcattcctaacaatatgtttggggtaatgtcagtttcttggaaagctcaaatgtaaaattacagtgctactatcagcatttttatttgagttgaaaactgccgtgttgaactattaactatgcttctgatctgaaccgatttcttagttagcaataattttcatattctgacttatgaagcattgctaaagactttagttatggttgggagagaaaactataaaacacttacgacttgatgaacacccctgcctctcttctctgtgggtaagagctatcgcttgtacaaaatgtatttttctctgccaccttttggcaattggtgttcactgtgcttcccagcttagccatagccccaactggccctggaggccaaactcttggtttctgccagtgatggagaccaagagaaaaacgatggatgtttcaagtaagatacctggaggatgctaaatctcatggacacagcttcccctagatctgactttccggaataaaggcaggcatataatgaaactaaaatagtgatgtgaaaaggtttcacctattctgtatgagtgtgaagagtgaaactttcgtgaattgttgtcttggttcattttctgctactaaaacagaatacacagactgagtaaattgtaaacaacagaagtttatttggctcatggctctggaggctgagaagtccaaggccatcaggtgaaggtcatcctaggtggaaggatggaagacagaagcaagtgttcaggatagaaagaaaatggaggcagaatgtattattttataaggagctcactcctgtgataatgacaataatccattcatgaaggatctgcctcttacgagtcaccttttaaagtttccacctcccagtaccattaccctggtgattaaatttcaacgtgagttttggcaggaacattcaaatcgtggtattctgccctggcctcctgaaacttctaacatacaaaatgcattcattgaatcccagtaccccaaaagtcttaagtaattccagcatcagtttgaaagtccaaagtctcatctgaatcagatatgagtgagactcaggcatgattcatctagaggcaaattccctccagccatgagctatgaatcaaagcaagctatctaattccaaaattcgatggtgagacaggaacaggatggacattcccattccaaaaaggagaaagaggcaggaagaggtaacaggtttcaagtaaatctaaaacccaacagagaaaacaaccttaagtttaaagctggataagaaacccctttaattccatgtccctcacctggggaacactggggtggggattgggtccccagggcctcaggaaaagctgccttggtggctttgttgggctcttgggctcagtttacccagcagctctcatgggttggagtcttatgtctgcagctctcccaggctgatgttatgtgctggtagctctacagttctgggatctcagggccagccccacttccgtggctccactaggcattactctagtggacagtctctgctgcagctctggcccattaattcgtctcagcaccgccctaatggggactctttgtgccggctccacctctaaaacaagtctctgcccagggccgcaggctttctgggaagtctttgaagtttaggtggagaaagccatgccccacagcttttgcattctgtgcacctgcagaattaacacaacatggatgccaccaaagtttatgattagtaccttccagagcagtaagttaagccaggcctgggaccacttgagccatggctggggcagctgaggaatactttgtcacaatgcagcggataggtcccgagacagcttgggtagcaagccacggagagtgcccaggcctagttattagctcatctagttattagattaatgtctcttctgcctctattctgctccctacttcttcctttattgtgacaatctaaagttggtgcttagtgtttaaatgactggttacatgaccatttagtttcttaacaagatgtagtgctaaaatgcatgagctcattccaccataccaaatcttgaccaccatatgccatcctcataactttctaacagttcttcctaatgaagttttctttctaggctatagtaggccaggaatctcattacacttgcccttcctcatccccacaccaacatatttattgatatatttcctaaccttagttaaagaatgaagttttgccatgtgcactctaaggtatatttgtgcaaggaaagacagcaatccttcccatctctccttagtgaggttaggggttaaccttcttggttttactaaatagaagtctacattccatataggcacacgagagcaagtttcctaatgtaactgtgacacaacacacgtctcaatgccctgcaggattgtgtgtcattgaccactgtgtttatactgataaacttttctataattgaagcctttggccctggtaacatttccatcctatatgacaccagtgaaaagttagagttttcattggtgccatatatggcctaacagccagagtgaccctcagatctcaccccagtagtggacctgtcaggtagatatcatctgccaacatccccaaggaggtgtaggtcttcaagtgtgagatcatccatgttatttccagcattgttgaacaagacacttcttgagacgcacagattgacaatagcttttgatgcttcccctgatcaaggagaaagagggtcttatcgggggcccatctactttggagacatctacattgtgtgtccctcacaggggagcagaattcacatcagtatgtaggctttcctgttcatagtggaaggggggccacagtttgtaagcatctctctatatcaggacctcgctaaaggctttcgcctgtaccccccaccttctctctctctctctctctctctctgtctcaacttctatacagtcagttcctaaactgtgagaggtaattccaatctacttaaaagagttgtaattttgtaaaatagaaattccaaaaatacttcaaaaggttacattatattatcaacagaagtttgacataccacatgaattatgagatgggaaaatgaaaaaatatggggacagtgaatgcaccaactagcatttacgaaacacacacagcttgctaggcattaggcttagggctatgagcccattgaatatgtgaagtttaactaaaaatcaaaatgtttatataatagataaatgttagattctttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgtgcccggctaattttttgtatttttagtagagacggggtttcaccttgaaatgttagattcttacatgagtatgttttcataaaacaaactacacactgtcactgtccagattcaatgggttcccaaaaacataacagcctgagagtcttagttgtgtcattgccttattcaatgtaataattattgcttgtaaaaatgttttaatccagtgataatccagatttagtactttcttccatcttggtgtattttatttattgctcatgctctattggggagcttacatgggatgttagttggcactttctgattactttatttaaaatagaaaaacatttcagaaagacatggttgtagagggtaactagcagagcctcatttgatgtctcctgttgagttacctgaagggagatgctcagaggaagagttgcatgcagaaggcctcctgggagtgtattctcaagagagacatcagcaagggtgtgaggaaggcagaatgagtggagggagaagcttctctgcaaagctctgatgatagcggtctcaggtgggatgcaccttcagcattgttgcaacttaacacgagggggccaggcttgtggagccacctttgaccagtcattccctgcaggcctcagacaaggcagttccctgtaacttgggctggttcccagtgtaggactcaacataggatctttccagctgctttggggcagggtgcattggcgctaaagaggaaatctgaagggagccccacagtgtccaccaagtggcagcagggaagaacatgctgtgagtagagtcaaccacatctattcagccttgtgccaatgcttggatgctgtgcttcctaacagcagggtggagaccacccgctaccctcacatttagtgagcaggttaaatcttattattataagatgagtccaatcacctttgtaaatagtgttaatttcttcatctctttcttaccaaatcatgtcagttaactacaggcaaagtgaggggctcatgtattttatcacatagacttagtagcaaccccagcacatagcaggagcctgtaacccctcagctccacaccacggagaaagactagatctggaagcacaggccatagacccactctatacagagctgcctgtaatccccacacaaatgaggggggactgttatgccacatttggttctaagatgagaaaacaaaaatctcaaaagccttcatcagaaagactgaatctagttctgccacctcctagccctgcgttcttgctcaagtgacagcctgtatcctgtgtccttggtcaagtgacagccctgtgaatctccatgtcaccgtctgcaaagtggagcctttgtttacctagcggagctgttgttcatctcgagtgttagaaggttgtctggtatgagatactatgaagcatacaataaatgttattctcacttctgaccagtgaagttcattcgaaatatctggggcttctcttctctcttacaaatatgtaactaggtatgcacctgctttagaaagtcatggagaagctcagatgtgtgacaagtaggccttcattatatttataaatcttttatttaacttgtaaattctggaagtcacgttttatttcttcacataaccaacactccagaaacacttgttataggcccttaaatgaattaaaaagccaaatgtgtatgaacacatttgatgatatttacttgtagaagcgaaaagagaaacaatttaaatgaaaagagcagaaaaacagttcataagaatatgtataaattgtgcattcactgatatttacttgtgaagtccgtatagaaccatggaataatgtagatgatgtataaaagaattaaacagttataaaaatggtacattttacgtatgtacactttaacatgatataattatatagataaggcatggaggcaggtggaccacaagggaaatgtaaaaatcaaaacagacactgtaggctggtggagttgagtcatgcttttgtcaaaattctctttattgttatgtcctattttaaataaaagtgtattgttgatttgacattgtattttctgataatggtgcttttttaacatgctttactctacaaagaacttaaatttacaagaaaaaaaaccccatcaaaaagtgggcaaatgatataaacagactcttctcaaaagaagacatttatgcagccaacaaacgtgaaaaaaagctcatcatcactggtattagagaaatgcaaatcaaagccacaatgagataccatctcatgccagttagaatggtgaccattaaaaagtcaggaaacaacagatgctggagaggatgtggagaaataggaacgctttaacactgttggtgggagtgtaaattagttcaaccattgtggaagacagtgtggagattcctcaaggatctagaaccagaaataccagttgacccagcaatcccattactgggtatacacccaaaagattataaattattgtactataaagacacatgcacacatatgtttattgtggcactattcacaatagcaaagacttggaaccaacccaaatgcccatcaatgatagactggataaagaaaatgtggcacatacacaccatggaatactatgcagccataaaaaacgatgagttcatatcctttgcagggatgtagatgaagctggaaaccatcattctcaacaaactaacacaggaacagaaaagcaaacaccgcgtgttctcactcataagtgggagttgaacaatgagaacacgtggacacagggaggggaacatcacacaccggggcctgttggggttggggaactaggggagggatagcattaggagaaatacctaatgtagatgacgggttgatgggtgcagcaaaccaccacggcacgtgtatacctatgtgacaaacctgcacattctgcacatgtatcccagaacttaaagtataataaaaaataaaatgttttacatatgatttgcaattttaattaaaaatgtggcaaatttcattgcataataaccctcagtgaagctagtaaagagagcaatttgatcccagcaacaagatctaggcattcacacattcagcttccctttactgagagtccagtgagagctgggctctatgctccaggtaatagtgggagtaaattaagaccttgtcctcatgaggcttatctctagtggcagaagatagacaataagtgaatataaaatatatacagtccaatggtggtcagtgtggggagagaacagggtttggggcatgaggcaaaaaaacaatctattaaaaattaacatccaggataacttaacagtttgtgtacaaaatgtgaaattaggatggtgccttattttttagtatcagcctgtctgctcacagcattttcagaaaatttgaattatttggttttatttgagcctgcgcctcatgattaattttcaggataactttctgaggccagacattgaactgcaaatgtcaaaggcatgttttactcacctatggatccctgtgttgtcttcttgcagttttcagtgaagacctacactccagcctctactttgtcaatgcatctctgcaagaggtagtgtttgccagcaccacggggactctggtgccctgccccgcagcaggcatccctcctgtgactctcagatggtacctagccacgggcgaggagatctacgatgtccccgggatccgccacgtccaccccaacggcactctccaaattttccccttccctccttcaagcttcagtaccttaatccatgataatacttattattgcacagctgaaaatccttcagggaaaattagaagtcaggatgtccacatcaaggctggtgagtacagctctgggctttgttttttctgtgcctgcttgggatgggaggataatgacaatgacacatagcaaaatgccatcacagcagagaaccaatgaaaaccccatcatcagttcattctgaccttgctgatgacttctttaaggtctccttgtttagatttcaaagtgccttacattgttggaactaaaccttgaaagaaagcagtgattagcaagttggcaagttctaacatcccagcctccttatattttgtctaatttgatactctaattcaaattttcagtgtctcaaacccaatgtgtttgcttccacccctccttttttcccacttgcccttcccctaccccatcctaggggaggagaaagagagagaaaaaaatgacaaatggttgagctggaataaaaccatagcatcaagatgtactgttatggaaacagaatcaatctaatatccttgctttccttgtgaaatagaaaggctattttaacatttttgactgtatcacatgttgctgaaatgttgtcagtacataaatcctgaatgggctatgttccttttaacaacatattgtgtctttttttaatcaccattgctacaagtcaacccaggaaagaatactgcctgagatacacagacatcaagggctatatatacaggacagattgtgtggttctatagatttaacaaagccctgcaaaacaaactcacagctagactcctgttagcaaacagcattttaatttttttaagtctagctctgaaatacttgtgtagactgacataatataatagcagggcaaagagaatgtgactttgatttttttcttatacaccaggtagctgggggagctttgcaataatttcttcagtaagtgagtaggtgctggtagaagacatcacaacatgagaaaaatatgaggtgtttctgaattcctgcatatgatctctttgatgtaagccatcaaacattagactatgactcatgctgctagctagtcattttcccaactatattttgatctttgtgacatgctcatgaattccaagacctgcatgagaattcacataagaaagaaaaaaaggattgtctttaatcaagatatatgaaaatttgatgtgtcaaataattacaatgcaatttgtatagggacctctaaacctgacaaacagggagatacagtgaatgacttttactgggaagactgcacattttaatgatgtgttataaaagcgtatttataatctgcaaaacaccacttatagggaaacctagaatttcaaacagctccatctgtgcgtattaatccattatgtctgccttggattttctgtcagataaaggaatgaaatgcttactcctgttttaactatcatcttctaaattagtcatagaattcattgtttttgcatgacactgaaagttttagagcatggacattgcatcatcttgtctggcgtctgtgctacctgcctcttcctacccagttgtgcttttactatttatgtgctggcgttcttgacatctgaaaccctatggactatgaatccagcatatggatgactactgtatcagtttgaacatataagatgggcagtcatattacccaaatcaaatttctctcctgatttcattttgctttttattgtgaacacataatggttataataatcttttaggttgttcactggatacttgaaaatcttttttcatcctgtttatgtaaatatgagtacagaactggaagcttgttcaaaaagacagatgaagggcataaatgctaccctttgacagctgaagggtaggtttgagggtgatgactgctcactcacggggtatcctcttctgtatcaggtcatcctaaatgtctaaatatccctgtagattggtgtttggattttcctggaataagctattaggtagaatgacttcataatctttcccttggcagcacaagggattctcattcttaaatttcagaaattttgacctaggtctgggtgctagcaattgaaggaaggtttactcatcatgtctcattaatcatcaatcctagtcctaacataagatattttcttgcctgttctaagggctggaatgcaggtgggccacttcagacagtattgctccttacccaggctgcctttgctacagagcaagtagcaatgagccgcctgatcctgggcaagtcagaagatttctcatgattgttttctccttagcagactgtgctttctttctttctttctttcttttttttttttttttgagactggagtctcgctctgtttcccaggctggagtgcagtcgcgcgatctcggctcactgcaagctccacctcccgggttcacgccgttttcctgcccagcctccagagtagctgggactacaggcacccgccaccacacccagctaacttttttgtattttcagtagagatggggtttcaccgtgttagccaggatggtctccatctcctgacctcgtgatctgcccacctcggcctcccaaagtgctgggattacaggcatgagcgaccccggccacaaactgctttctaacatttgactaggacttttgcttgtggccgagatggaggtgtgggagccacatttacccttttatctgaaacaaccaaaaaccagtgtcctgaggctgatagggtttaactctatgtccgcacccaaatctcatcttgaatgataatccccataatccccatgggtcctgggagggacccagtggaaggtcattgaatcatggggtaagtttcccccattctgttctcgtgagagtgagtgagtctcacgagatctgatggttttataagcatctggcacttccgttgcttgcattcattctctctcctgccaccctgtgaagaggtgccttatgccatgattgtacgtttcctgaggcctccccaggcagttgaaactgtgagttaattaaacctcttttctttataaattgcccagtcttgggtatttcttcatagcagtgtgagaatggactaatacaaccaactgaaaaaaaacaacgaaaaatgcagacaaaatatctgaagcaaccattttcaagactggacctcaggcagtagaggaaagcattccttaaggagctggaaataagatgtgtcctatgcttgccttatgctttgggataaagaatatcaaaatctgcacataaatttgtatagcaactttattcctaattgccaaaacatggaagcaacaaagatgttgtttagtatgtgagtggatggggataaagaatctctccttgactaactttggaaaggctcctctgagccctcctctcaactagttctcaaccttagcttttcacatctggtctcttgtccccagctttagcaagaatcctgctaaatcatccccttactcttgatacttgatcactcttaatatctgatcaagttcttccagtcccatctttgatgtatacatgtttggcctgattttagcaagaatctgttaggccagtttagcaagaatcctcatcccttgatgtctcctctttctaattttccacccactgctcccctcactgtgttcattggctataaaccctcacttatccttgttgaatatgaagttgaattacccttccctgttgcagtcatcatagatgactcctactggaacagacatgaatataatcttatctttttaataagtgttagaacatttttttctgttctttaatatttttgagaggacatctccctctcttgtccaggtcggagtgcagtgatgggatcgtggctcactgcagcctcaacttctgggctcaggtgattcccctcagcctcccaagtagctgcggctacaggcataagtcaccacacctggctaattctttaaaaaaaaaaattttgtagagggtattctcactatgttacccaggccggtctcaaatttctgggctcaagccatctgcctgcctcagcttcccaaagtgttgggattacaggaatgagccacagggcccagctacaatttttctttaacattagacaaattatagtataaaatgaagtattagtcagcgatagaaaaaatgtgctatcaagctatgaaaagatatgggggaaatttaaatgcctgttactaagtgaaagaagccagtctggaaaagcaacatagtatacccttccacctacttgacattctggaagagataaactagagagacagtagaaagatcagtagtttccaggggatagtcaggagggagggagggttgaacagacggagcacaggggatttttttagggcagtgaaactgttctgtatgatactgtaatggtgatacctgccattatgcatagaacttacaacatagagtgaaacttagtgtgaactatggactttagttaataataataatgtataaatatgagtttattgtcacaaatgtatcacattaatgcaagatgataataatgaaagaaattaaaggatgtggcaagagggagaatatgggaacctgctgtgaacttttctctaaacctacaactgctctaaaaaaaaatcaagctttattcaaaaaaattaaaacatgcttcaggaagcttaatgacaaattaagccccaagggaagggatggtgaaatttaaaaagaagtggaaaaatgcaggccaaaattttccaaatttgttgaaaactataaacccacagatccaaggagctcaacaaaccccaagctcaagacacgtgaagaaaaaatgcacaaaggcacatcataatataataaaattgctcagcgcaataataaaatatcaaaagcagctacagaagaaaggcatattacacacaaaggaacaaagataagaatgacagtagacaggatttttgttgttgctgttgggtgtgtgtgtgtgtggatgtgtgtatatgtgtgttttatgagacagggccttgctctgtcaaccaggctggggtgcagtggggtgatcatcgctcactgcagcctcagcttccctggctcaagtgatcctcccatctcagcctcccaagtagctgggaccagaggtgcatgccgccacatcaggctgatttttatttttatttttgtagagatggaatctcgctatgttgcccaggatggtcgctaactcctgggctcaagaagttgccctgccttggcctcccaaagtgctaggattacaggcaagagtggaagtaaatttataaaataatggtgagatgaaggctttctcagacacaaaatagcagaaaatttatcatcagctgaatcctactacaagaaatcttaaaggaagttctagaatcagaagaaaaaaatgacacctgatcaaatcttagatctactcaaaggaaagaactgcaatgaaaatggtaactacatgagtatctaaatcagattttttaaaaaattgcaatattttaaaaaataattggctatttagacaaaaatagtaacaatgtcttaggtagtttgtaacataggcagaagtaaaacttatagcaacaatagcattaaggcctacagtgaagacatgggagtgtaatattggaggttattttgctatatgtgaagttgtgtaatgtcacctgaatatagatggtgataagttacaaatgtatactacaaaacctaaagcaacctctaaaataacaaaacagagttatagctaataagcccacaaaggagaaaaaatagaatcattaaaaaatcctcaatccaaaacaaagaagaaaatgataagaaaaaggaaacacggtaaaaaaaaaatacatatcaaatagcaaaatgataaacctaaccgtatcaatatccacattaaatttaaatgttccagtaacctgaattataaggcagaaattgccagattggatttaacactgcttaaaagaaacattctttaaatacaaaggcacaaatagcttaaaagtaaaaggataaaaatgatataccatcctcatcaaatcaaatcaacctaattaaagtaaaccactgaaagaaagctagaatagccacattaatattaagcaaagtgtatttccaaacaaatacactgtttgctcagagcatcttgcattagtgtgatacatttgtgacaataagctcgtatttatacattattattaactgaagtccatagttcacattaaatttcactctatgttgtaagttgtatgcataatggcaggtatcaccattacagtatcataaagaacagtttcactgccctaaaaatcccctgtgctcagagctaaagcagttcatttcataatgtaaaggggggaggtgaagaggatatgactattgtaaatgtttatgtacccaacaacaaaacttcaaaatacataaagtaaaaatggatagaactgcaatgagaatcagacatatcaaaaattatagccggagatttcaatactcctagttcaataattggtagaagtagacagaaaatcagtaagaacaaaaaaacacgtgaatgacactatcaatcaatttgatgtaattgacctttaaataaagaacattctatccaacaacagcacaatataaattctcttctgagacacacagacatttactaatatagaccatactcagagcaacaaaacaaatctcagataaatttgttttaaattcaagttgtataaaatatgttgtttgatcataatgaaattaaatcactaacaataacatctctgagaaataaccaagtacctgaatactgaatagcactcttttaaatgatctgtgtcaaaaaaaaaaattcagaaaaaaatttgaagaaggaaattagaaagttttttcaactgaataagaaatgaacacacaatatatatgaatttggggagtgccactaaaaaaatagggagattttattgctctaaaaaacttatattagaaatttttaaaaaagtcttaaatagtggtctcagcatccattttaaactgaaaaagaggataaaactaaaactataagcagaaagcaaacaatgaagatcagaatggagatcaataaattatagaacagaaagaaacaatagaggaaatctatgaaactaaaagttcttttaaaaaaattgttaaaattggtgtgtttttcaccagaaaagtgagagagttggtaaatgactaataccaagaatgagggagataacgtcactttatcttctacaggtattaaaatgatactaagagaacattaagaaaagtagatgaaataaaatattttttgagaaacacaaactatcaagactcactcaaggaaaaacagataaactgaatagccctatatctattaaagaatttaaatttattggtaaaaattctctacagtaaaattcctggctcaaatggcttcactattgaattctactaatcctttaagaaagaaataataattttggccaggcacagtggctcatgcctgtaatcccagcacttttgggagaccaaggcaggagaatcacttgaagtcaggagttcaagaccagcccggccaacatggtgaaaatccatctctactagaaacacaaaaatcagtcaagtgtggtgacacatgcctttagtcccagctacttgggagactgagacaggagaattgcttgaacccaggaggcgaaggttacagtaagccaagattgtgccactgcattccagcctgtgtgacagagtgagggagactccatctcaaaaaaaaaaaaaaagaaagaaagaaagaataaaaattataaacaaattcttccagaaaattgaggagagagtatttcccaaatcattttatgaagttagcattaccctaatacataaacaagacataagaaaactaaagacaagtatctcttctgactatacatgtaaaaattctaaaaatttaacaaattgaatccaacaacatataaaaggaataatacattatgaccacaaaggcttatattcataatgcaaggtgagtttcacatttgaaaattaatcagtgtaaaccatgtgatcatttcaacagacacagaaaaacattgatgaaacccaacatccactaatgattaaaagaactctcagaaaaccatcagtagaaaggaacttcctcaatctgataaaaagcaactacgaaaatcctgctatagcgaacatcatacttgtcaaagatgaaatgttttcacccccaaatgaagaacaatatcaaagtgtatgctctcaccacttctattctacatcgtcctggaggttctatcctgtgcaacatgacatgctataagaagatgtgctgtgacccagaccttcttgttttatttctagagcataggcaaagtagatttgtcataattaattctaagaaataattttagaattattgaaatggtaaatgagcattgacttcatcttagtcatcagctgcattaacccttaacaagaatcagcttgttttttgaagcattgaggctaggcattgacttctcctctctagctatgaaaatcctggatggcattttcttttaatagaaggatatcttctgtacattgaaaatatattgtttagggcagccaccttcatcattgacattagctggagcttctagataacctgctgcagtttctccatcaacacttgctgcttcaccatgcatttgtatgttataaagattgcttctttctttaaatctcagtagccaacctctgctagcttccagtgtttcttctgcagctttcccacccctctaagcctccctggaattgaagagagctaaggacttagtttgatttaggctttcgcttaaggcaatgttgtggctagtttaatcatctctccagatcttctatctactcaaattttctccacaccaccagtaaggtagtttcactttcttatcatttgttcgctgaagtagcacttttcatttccttcaagaacttttcctatgcatttacaactcggctaaatgcacaaaaggcctagctttcagcctgtcttagcttttgatatgccttcatcactaagtttaatcatttctagattttgatttaaagtaagagatatgagaccatttctttcacatgaatacttaaagaccactgtagggttatttattgatttaatttcagtattgttgtgtctcaaaaaaagggatgcttcaggagagggagaaagacggaaaatggcatgtcagtgaggtgggcagagcacatatgacctgtattgattaagtttgctatcttctgtaaatgtggtttgtggctccgcaaaacaattacaatagtaatatcaaagatcactgatcaatgatcaccgtaacagatataatgattttaaaagtttgaaatattgtaagcattaccaaaatgtgacacagagacacaaagtgagttcatgctgctggaaaaatggtgctgatagagttgcatgatgcagggtttccacaaatcttcaacttgtaaaaaacataatctctccgaagtacaataaaatgagtatttcatgtgagaaacgcacatacagccatccagatgcaaagaatggactcagagacacgaagaacagcagaagcgactctttttttttttttttttttttttttaagacggattctcgctctgtcgcccaggctggagtgcattggcgcaatctcagctcactgcaacctctgcctcccgggttcaagtgattctcctgcctcagccgcactagtagctgggattacaggcatgcgccaccacgcctggctaatttttgtatttttagtaaaaatggggtttcaccatgttggccaggctggtcttgaactcctgacctcaggtgatctgcccacctcggcctcacaaagtgctgggattacagatgtgagccactgcacccagcctaagcaagacttttgatgcaagatcaggcgcctgttaggcaggcacacccagggcaggtagagcaggtaatttattgcctagcaagcaagtccctcccccagttcctcattgattgagtactatggagttacaatcttcctggacatcgcctaagtttcattatcccccttttaaagttataacccaatccccttccccacttaagttttgatttcccagtaacaaaactttcttcccttttatgggctgacccctcgtctacattctgtttgcttatcgtgaccttctaggtgcatgagccatgcaatttgttacatctgcaggctggctgccagtgcttagatttattatgccttgaaaatggaccatttaaaatgttttctcacattcgctgctgtcaatgtagaccaaccgtgtgatctcttgctcaataaataagccatgtgtgtgtaatcaaagtaaagttgatttcagttttaaataacttcttataactataagatgcttttcgtaagcttcatggtaaccacaaagtaaaaacctatagtagatatgctaaaaatataaagaagtatgaaagaaattgaagaggacacacacacacaaaatggaaagttatttcatgctcgttgattggaagaattaatagtgttaaaatatctatactactcaaagtgatctacagattcaaggccatccctaccaatgacattcttcacagaaatagaaaaaaaaatccttaactttgtatgaaaccacaaaagactccgaaatgctaaagcaatcctgagcaaaaagaacaaagctgtaggtatcacacagtctaatttcaaagaatacaacacaggtgtagtactggcatactatagcatagtactgacataaaacagacacatagaccaatgggatagaatagagaatccaaatataagtccatgcgcttatacccaaatcatttttgacaaaggtaccatgaacacacattcaggaaagggcaagctctttaaaaattagtgttggcaaaactgggtatctatatgcaaaagaatgaaactagatccctgtctttaactgtgtatgaaaatcaactcaaagtgggcaaaatacttaaactaagtcttgaaactatgaaattactgaaagaaaacactagggaaacactatagaaaattagtctgggcaaagatttttggggtaaggcctcaaaagcacaggcaacaaaagcaaaaatagacaaataggattacatcaagcagaaaaactctgcacagcaaagaaaataaaaatcagcaaagttgaagagacaacatgcagaatggggagactattaatatttgcaaactctccatccaacaagaatataatgatggatgaaactggaggttgctatgctaagtgaattaagccaggctcagacagacacacattacatgttttcactcacatatgggatctggaaaagtggatcttatggaggtggagagtggaatggtggataccagaggctgggaagcaaggggatgaggagaggggttaaagagtagttggctgaggggtataaaaatacagttaaatagaaggaatatgttctaacatttgctggcacagtagggaaattatagttaataatttattgtatatttttaaattgctagaagaaaaaagatttactgtgctcccaacacagggaaaagattgaagtgattgatattccaattaccctgattttatgattatacattttatacaggtatgaaaacatcacatgtaccccagaatatgtacaactcttatatcacaatgaaaatatttgattaaaaaaataaataggcctgattttgtttcaaagtcatattaccagagatttttttttcttctgatctaaaaagatgacagattttactgaatgaaggctaaaatgattgcagtggaccctactggcatccctgaatcagatcccccaagatctgcgcgctggttgctaagaacatgaacctgcagccttcagaggattgcttgggcactggaaccattcacagaaacaagagtgggaaatgcctgggagttccatcctcctgaggccagccctaagccaatgacagacagctacaacaggggatcccagctcctctgcatgaccgagcatgtcaggtgtggctgggacttcacctgaaaccacacacctgctttgctgcttccctccctgccctactcacactttccctgcctctcaggggattgtgtccttgctcagtcgcttgaacccagctcctccttttggggtcgaataaggagaagggatggggagtgtgcagttttcttctgatccccgttctctctgagcgagctggggttcagagcaccacagtgctgtccctgctttgagaagatctgggctctctggggagagcctaacttatgacaccaagcacagtacttagataatactctgtcttataatgcaaatgtcaatcaaatttaaaacaaagtgtatttttttttttgcctgcatctcaggtttctagcccagtgtctgttactgcaacaaagttagcagtagttggatgtagaatgaagatcaaggctgcacccctgtcttcggggctgactatgggctcaggaaactcacatggccctctgagagatatatcgccatagacagcaatgttggtgtcttaagttatggaggcctcaggaacaaacaatgctctattacaaagattaggagctttaataaaaccctgatttgcatttttttaaaaaactatagatagtggctataaattcaaatgtgcatacatgtatattctgtaaaaggattagaagttctcccagaatggaagctctgtctttctatatattcagtctcaaaatatgtattgaacacctcttgtgtgccaagtattttctaagataattttttaaaggctcactgcacaggctatctttgtggaatgagtaatcgaataaggagaagggatggggagtgtgcagttttcttctgatccccattccctttgagcgagctggggttcagatcaccacagtgctgtccctgctttgagaagatctgggcttcttgggactgacctggaggttggagaagcaaaagtcacacaggtttaaaattgtgactactaaggtgtcctggtactggtgagggcagtgggtagctagagaggagaaaactccatgatatgtgggtaagtgctgggactgaggggtttcctaggacactggacattgggtggtaacactgggaatgtccccggtcagtcaccccatatttttatggctcctgtgatcccatctagtgtaggctgtacacctggtgggaaggcatttcccgtgtctcccggtaaacaggtgaacatcttttcttctcactttcctgtctgatacatggaacttgacccctttccttgatttctattaaaaattatcctacttgagtcattaatgtttgaagcagagtctgcggaaggtttggggagacagagtgattttattgcaaagaaacaagcatcacacagacaaaggagcttaaattgaaatcattcccctgcttaggggcactattcctgtgacggtagactctctctgttgaccagtccctctttctcctctgtcctccatcctcctcttctcctctctgtcttctgcttctcaccatgcccagattctcaccaatgagtttgattagtttgcctatatcttcatagtctttttctaatctattaccgtagacctcagctcccagcaaaggtttacttatgcaggagcctttctgtacaaagtcagttccctcctctcggtgtaaggatgttgttgctgaggtcagtctcttgggcgccctgaatttttgcctagtggacctcctgcaggaggtgtggagttgctgcctggaccttcacctcatgccgcttggggattacagtgatgggggtcgcagaagatttcaatacttggaaaaatctctctggttagatacaataatgaagaaattctccaagttggggaaaaacggctaatgttaaaaatggaaactggagaggaaggctttcatgaaagacatgctttactacaaaaatgctcagcatatcacaaggttagcccgaccttaacagtcctcttctaaagagctcacctctgcctactgggagatttcccttgagaaattcacctttagctttgttggtgtgttagtaccttttgaaaccattttcatggcacatatttgtccagtaagtgattaattctttaagtgaggtggttagatgattagacaataagttatctctgtgggtatcttagaaaatcatagacttataagatttagaccttgaagaggttcccaccacaatgccctcattttaaatttgaggaaaacaaagctctaaagaagtaaggctggcacatctaattgggactatattcatcagtgtcttacttccctggagacagatcttccccaaccctggggatccatctctggctattggtaagtgtggccttacccaacctgcttctagcagacactgttgaattttcacctacgttaactgattcaccacagtcaccctagggggcagatgctaccaacatcatccccatggtatagatggtgagaggatttgctcactgccccacagtcagggagtggccgagcttggatttgaacccagggagttgggcctgctaggtaggttctgaacaccagtaccaccctgcctctgagcctagacatcaaggacgtggaagtccactctgcagtctttctgggatgctcctatcattggagtgtttgggcaggctgtctaatcaacatccttccctaaacaatgggaagcaggatcagtgtttcccaaactgctttgcaactgtcatttaaaaatttactaatgaaaaattattttaattgtctcagagttctcaaggcttcccagaaaaattgccttgcctgaattttttattcattttttgcagtcagaaaaaaaaatcttcctcggcccttagaggactaatagcagtttgccatcatcataactttgcagagccagtaacttttctttcatgaagctatttcctatctcatgataccttcagggggtctattaactattttcgattatactctggccccttggtatagagtgtagtgtatttttttttcttcacccaggctgggtgcagtgatatgattatagctcactgcagcctcaacctcccaggctcaggtaatctcatctcagcctcccaagtagctgggactacaatcacacaccaccatgcccagcaatttttttgtatttttagtagagatggggtgttgccatgttgcccagtctggtcttgaactcctgggcacaagggatctacccatcttggcctcccaaagtggtgggattacaggcatgagccaccttacccagctatgtattgttaagggaatgaatgttttcttaagtcaggcgatgaaagacgtgaaatgtaggcatcttaactgttttccagaaagatatgttatgcaattgatgtgtgtgtgctgcagtgtatatattacagtgagatactctcagaatgagcctgttgaccgtgtgccttactgacgtcctctttctgccttccagttttacgggagccctatacagtccgtgtggaggaccagaaaaccatgagaggcaatgttgcggtcttcaagtgcattatcccctcctcggtggaggcgtacatcactgtcgtctcatgggagaaagacactgtttcacttgtctcaggtaggctttgcgtctccagggtgcaggacaccacgctcaccttctgaaaaggttatttcagagatggaatcgggtctccgtttatgtgttcatcataattcagaattagtattcttaaggctgatgctattttgtaagtaaacctgaaataagtgttttgtattggcttataatggcttgattcagacatcctttggtgggttgactgatgaagagagattagttaccggcactgtaactgtagccattgtgttaacttttttgagaaaattgtggttttacgtctgcttctaaaaacaaggtagtagtattttgcatctgtgagagacctcagcattgcatatatagctgacattctgaaactaaaatctggaaaatggaagccctgttttcatgaccttttggtgctttccaatgtcttgagagttatgttgtatctctgacctatttcttgaagattctactaagaatatatatgtagcaatgaaatgtatatttgcatatgaataatttcttggcttatatttggtgtgtagaaaagacaaaatttaaatttagcctccaagaaactgcagttcttcatttctaatggtgttgatttcttgctctgtgctatttacctggaaaggcgactgtccgcgtgatgcatggtgctcctgttcttacatccttggataatgactgttggcatatctcaaaatgtgttggctgctttcggaaaagaattgtgaggagcatagtctgtgttccgatgtggattataaatagttgccttttttagacatgtctgtatgccctcacatgcgggtgcacacacgcacaacacacatgttaacagacttcttgactaagcaacattttatccatttatagagagcagaatttggaactaaaccctcacggtgacacaccgtttttgtttctcagcttattgattagctagagaggttggttactgtacaccaccaccagaggcatttaaaagatccaaatcaaagttgaaatacattgccatcatagcacattacaggaatctaggatagaatggaattcttagtttttatgaaaacattgtctttacagtgaattcaaaacccctcacacttcaatgaacagtacattccttgctgttatgttgattaattatcataatttaacttagggtgttgaaaaatactaagcttaataactcaaatgcgattgtaataatcagaatagagactcccttatacatttttatttgctaattttcagtgttgaaacatcttcatcttctctccttaggggtcatgttagttgtcttaatggcaaatggaaggatttgatgacagtcatctggctaagctcggaatcaaaggggagaggccctccaatttatatggcaagggagtataggttcagggagtggaagaattgggagctaccttttcaatcttccggactcggtgacctaggatagagacttcaccatcttttaaccctgtcatccaaattttcagcttcatggtctgctctggcagaggaagagagcatgggagaattacaaacgccttcttagtgcttccacttggaggtgacacatgttatctctgttcatatttaattggccaaagcaagtctcatggccatgcctgacctcaatggggcatgtgcctgaaggaagaggagaactggaaatctgggtgagaaattgaaatatctaccaggaggatttttttaacttttattttaagttcaggggtacatgtgcaggttttttacacaggtaaacttgtgtcatgggggtttgttgtacagattatttcatcacccaggtgttaagcctaatacccattaattatttttcctgatcctcttccttctcccaccctccaccccgaagtaggccccagtgtgtgttgttcttctctatgtgtccctgtgttctcatcattcagctcccacttacaagtgagaacatgttctaccaggaggatttttgaatctctttggttatgcataatacgtgtgttcttttgtttttagacatctttaattagcagcatcctcattgttcttgtttcacctttttgcaatctctgtgaacagactttattttccttcaaatgtgaacctaactaaataaaaaaaaggaaatgtgtatctagtgaggggatgatgctggcatgcaatatagaatttatgcccctctgataggaactgttaaagcccatgtcctctcctcagtcagatactggagcttcatcctttcatacaattttaaatgcaaaagttttggagaagtgcttggtttgtacttcacaacagcatctagaaaataaatacaacacaggtgtttatcttattaaggaatacatcagtaagaagctttggttggtttgtaagtaaatcactgaaagaaagggagagagagacttcatatcaggtcgttcaacctgagtcgaatagacttgtcactaaaaatgaccttgtaaatgacaacaaggccccaaagcagtggcatgatctgctaatagaaagtctggaaattgagcattttacctgacttctgttgctcactgctacagtcagaccctgttcccagtgtctgagctccacccatcagcaatgcccagaaaaggaggtcatgaagtcactggaggtgacgcatggtttaaaacattggagatcttaataaataaaccatgctcaggaggtttaggtggagaagggttatatttctctctggttaccagcacaaggcacagataaggacagaggacagcctccctcccccatcacccaggctgtgccggggtggaggccgctaaaaggaagaccctccctccctccacactggctggggctgagccactccagggaagcactgggattcttggcttcagggaacgaccttgcatagcacagaagtcccaggaacagagggactttttctaaattagccctgaccttcagggaagctgtcctgaatgccatatgcacagcagatgacctgtaaaaggttaatttgtctctgctttgtatataaactgtaactcctgcgagctagtttggatttattccttggcatggccatctcccaggtccctcttcccggattatcaagtcatcccagcctgctgggatctggctgggaagtttgttccaggaagcattcgtactctgcagagatcacttccttcagtggttgattctttccatggagaaaagcgattaactaaatcagccatggaaataagcctgtgtaagtatcttactaagtgagtgagttaggagcaggtatgggagtgccagagagttgacctaggatagctgagagctgatggcagtcaagagagggcccaaaagcatgattcacaggccatggcccaacgtgccccactgggctcagggcgaagtgtgacctgtcagcctgggggatgcttagctgctcagccttgactgttgggagatcccctgggaaggtcggagcagcaaagacctgcttctaacagatgagctttgggtttctgtgaatctctaggccaggggacctttggaaatcctggtgaaggtaaatgggtatttgtcttctacaaattcttttttaatgaaaagcaaaattaaagatgtttgtgtatttccctaaaaagaagcaaaatggtttctattagtatgtctcactaggttttgccctttattttggttaagaaaacaaatgagtagtttattttcctgagaagcacaaatgcagtgtttgtcagggtttaatgagtgttgtgcatattgtcatggttccttttgggagcttactgcacattagggcctgcattgatttctttccaggacaggcttcggttggcctgaaggtagacgcaggaatcaagttatgcctcttcatcatatgaggccatgaggctaccattatcaaggacattaatgagttcattgatttggagtgacctttggaaagaataccccaacagctgaaaagtagaaatcccataattctaccaaatggaggaaagattcataatatctgatgttgcttttctgcctgcctgagctcttccctgggccctggggccttacagggtgacccttccctctggtatgatggatgggggtggggtcgtaaatgtgcagaggaaaagcatttcagagacaggcacacaaggtgccatcagatgacctcagttaatatgacagatcctgacctattgtgttcttacctccctaaaatgagccaggaagaacaagagtcatgatgtctatgtggatttttttagacatcctcatcacttatcctaagctgcaatgaaatccttttaaatgccataatattaatgtagcccagtaaaaatatagtagcttgaataatgacatgcttttggaggtactgctgatgtggagatacataaaacaccatcctggaaaaaaacaataacaccggctttatatttgggtttcccttcacaagcctgttgtgaatttcctcccgattagggaggccagcagtaagagagcccagccttccgtttctgtttcttctgataaaattgtgagaatctcaccaggggtttagctacattaacatcaaagacacagcccaggggtaaccggatttggaaaatggaaaaagcaaacattttactattcccagagaaactgcctccctctttagcagtggcccaattttctgctgtaatatttcctatctgaatacctctattagtgatgattcaaggagaattttacctcttaggatcattgagttcaggtcgaaggatgattatcttctttctgtattttggctaaacgtgaacaattttctgcccacatgaaatatcaaaggacataaaccaaccactttacatgaaacattggctgtaattcttcactgccacaactgggtctgggcatcatagatcacgcaagacttgggctttaagaagcactccctccccaggcccctgcagagatggtttctgctgttgagatgcttggggagattcctgcactgtccctcttggggtgttaagtgctgcagtaggcgcttagggcctgaggctgtagctacacacacggttttgcctggggaagtagagaaggtttcagaaaggaggttgtgatttaagaaaacctttgcattttagagaggggaaaagagattataggtacagccaaccaaattagacaaggctgcccttaagcacgtttcagcaaaccagaactaagagcagattggatgccgtattctcatgtggggagggagggagagctagcacagctgtcggggggacctgagggtcatgctgtggggggcctctgctttgtgcactcttgactatagaagttaaccttccctttctgtggcacttctattgtgattttattgctcctcactgagcattttccagacatctgctatgctgtggctgctatcttgcggagacctgagtctgccctcaaagagcttatgagtaaaaggaatgagataaacattaaaataatgtgaaatttaaaaaaaacctagagtcacctgaaagcctcatctttgattttaaaagtgccagagagttgcagaattaaagaagcatttctttaacattcactgaaaagaaattcgtgggaccaaatgaaaagtataaaaggaacatttttctgtctgttatcatctacctagctatctgtctttgtatgtatcatctaatcttctatttatattgcttttagtaaataagaacctcattttaaacactggaaagtattctcagctcagaacgtgcacatcagactggaattagaaaggcacagagatgtcatgtttttaccatgctatatttttgggagtgaattaactgagaaataggaagagagggccctggtctctttctttttaaaaatcattaattatgttatactttttccatttaagtctatcgctcactaaattaggttttgcatgttaccccgctgccacctgaaagtaattaaaagctggttgtttacagctctggagagcccctgtgtgacaccaagaatgggggtcgtgtaaggcgaggggcacagcctgagtctccaaacagctgccagcaaggctccaaagcagccacaatagcagctagtctgcagggcctcagcctgccaggaggagacctgcacccattctgaaagctgcaaactgtgtattgtggagtacaacccaacacagagaagtacgcttttgacttttgaactaccaaaacaagtagatagacacatagagataggtatgttaatattttttctttaaaaaagaaaacaagaaaagaaagcattggggcaaatttagcccagaggatatcaggaggggtgtgtgtacatgtgtgtgatgtgcgtgtccacatatgtgtgtggtgtttggtgtggtgtgtgcatacgtgtgtgtggtgcatgatgtgtgtttgtatgtgtgtgtagtgtgtgtggtgtgtgtgtggcatgtggggtgtgtactctgtgtatatgtggtgtgtgtgtgtgccgtgtatggtgtgtgagctctgtatgtgtgtggggtgtgtgtgtggagtgtgtgctgtgtgtggtgtgtgagctctgtgtgtgtgtgtgtgtgtgtggagtacgtgctatgtggtgtgtgtgctctgtatgtgtgtgtgtgtgatatatgcagggggtgtgtgtgatgtgtgtgctctgtatctgtgtgttgtgtatgtgtgtgtaaaacctcatttgttgggccactcagtcacactaaaatcccccttgatttcctattttaagtttctggaatatgacttgattgcagcgctgactcaggttagctgggtggcctagggaaaggcgtttctatctctctctgtttttgtttttgtttttgtttttgtttgcctcagtttcctcccatggatatgcagtgatttctctagtcctctcccacaatacaatgccaggatattaaaattccaaattgaatattccacttcttaagccaactgctgtcaaagttattttttcactttcttagatttaatcttgcaggatgttacatgcccatgtcaaaggtccccaagcccaccctcaggtttggtgatctgccaggaagactcagcatgtagctgcatccatggctgtgacttaatacaggagaaggctatggagcaaaagcagcaaaggcaaaaggcacatgaggtgacattcagaggaaagcaggccccagctctcaggggtcttctccctgtggaatcactaggaagcacttaatttctccagcaatgagtcatgataagaggtgcaatgttgtctaccaggggagcaggagagctcctggagactcagtggccaaggtttcctttgggggcaggtcacgtaggcaccctggtatgtttggtatgtgccaaagttccagactccccaaggaaggcaggtgctcatcatgaactgtattgcttatgcagttcaggcagtgagccactctaagggtggtgggaacgctgccaatatcctagttcccagataccagccaagggacagtcctgcaagcagcccttcataagactgacagtctcagacctactgtgttaactcttctctgtgccatgcaactttttaaatgatgttggctcatcttcattttcatacattcaacgatcactttgcatatgctcatcatgaaatgctggagaaagcaaatgaagaaaatctatgctttatgtactttattgccttgtacccaagtatttcaagccttaagaaaggtctcatcccaaattattttaaggtctgaaaacacattgactcatactcttcccttgctccacctaagtgtaaatggagttcattttatattctgccattaaggatcttctgctttctctctctccccgtgatgtttggttctttctagacatgggaaacagatggccagctaagtcaatcagatgtaatttggacacaagcatattctctggtctgttgttcatctaagagttttcatttcaggaaaattcaagagaataacaggatcatttaggaaagaatattgtgtagtgataaccataatgctgttagattattattattatcgacaagctaaaatagatgtcacaaatcaagatttgcttagacaatgtgccacagtataagaaaacaggatttgagattgagaaatataatttttgactcagaataacttgctagctactcaagaagtcagtgtgaactcaaggtattgtcgagcagagataaaggtgggttggaccaggcttatggtgctgtgtcctttgctctgggctggagcaggtggaggaaggtctccttaagcagatgggttgcttggcctccagaaatccctcaggcggagctaccatggctgtcagccctttgtggctgtccttctgagcagatggggcaggatggagtaaaccatccagcagcccagacttcctctctcctcagcaaccgcgtcacctgtggaatcctcagtctaggagccaccccgcttcccttctccaccgtcagcctgtggagcgttcctgcagactgggcacattgagcatttatgccagtccggtttcttttttcttttttctttttttttgatggagtctcactctgtcacccaggctggagtgcagtgacgcgatctcggctcattgcaacctcttctccaccgagttcaagtgattctcctgcctcagcctccggagtagctgggactacaggcacctgccaccacacctggctatttttttttttttagtagagacagggttacaccatgttagccaggatggtctcgatctcctgacctcgtgatctgcccgcctcggcctcccaaagtgctgggattataggtgtgagccaccgtgcgtggcccggtcttaaccagctcttcactgattgtctggatgctcaggtgtttttgcgcccgcgtctgtatagctgaagaggtctttcccaagctttttctcagcatcctggagcaccccattctcaactctgctgcacctactctccagtgttcaaaggatcgtaacttttcactctgcaggggctgagaacagctttcttcagatgaccctttctacctccttcatggctcagccccacgttctctcccacaggaagagctgtcctctttccttccagcttagcctcccaccgtgctgccctcctggtccccttacctgctccggcgttctaggacctcttttcatcagctgtgccctctgttgcttcagacagcttctctttagtaattaccgtatttcttgtgacacaggtgctcaggtcccccagttttaaagaaacctttccctttgctaacttccatacttctttctttctctgtctttactttcttccttccttctttcttttttctttctctctctctgtcacacactcctttcattctttctctttcttctggcaaactgtttgagataatagtttatagtagtgagtattttgggctttgcctgttacaatctactgaaattcactacttcaagatcacccatgacttccaaatgttaaatcccaaggctgtctcctggtccagtttctctctgacctccctgttagatgtacacagttgacctacttcctctgttggttcctgtatttggcagctctggacgccaaaacaaaatatcacacactgggtggcttaaacaacagcaatttatttccttatagtcctggagcctagaagattgagatcaggctgccagcatggtcaggttctgatgggggcctcatcctggcgtgcagatggacgccttcctgctgtccttacatgactgactttctcatgtttcttcttgcaaggacactaattctatccgattaggggccacccttatgacccgatttaaccttaattactttcatactccaaattacttctcttagtaattactgtatttcttgtgacacaggtgctcaggtctcccttcccttcccttcccttcccttcccttcccttcccttcccttcccttcccttcccttcccttcccttccctcccctcccctcccctctccttccctcccctcccccccccctccgctcccttcccctcccctcccctcccctcccttcccctccgctcccttcccctccgctcccttcccctcccctcccctccccctccgctcccttcccttcccttcctctttctttctctctctttctctttctctttctttctttctctctttctctctctctttctctcttctacctttattttcttccttccttttctttctttctttcttttttctttttctttctctctctttctctctttctttggggttagggcttcatcatctacaactttaggggacacaaggcagttcatagcagttgctctcctttggtttgtatccaactacactgcctggttgatcttctctctgaatatttcggtgctatctctttccttcagtttgcatcttcccctctcagaaatgtatgtcaatctaaaagtccaatcccatccactttctgtattggtcatttcatcatcttccagggcttcatccatgacttgcacctgtgtgaccccaacttcggacctgccttctctcctggtcctgcttattcactcccccgcatccctctggccacctccaacaaaggaaaccttccccatgaccacaaaggaatttccctttgatttattcatttatttttcaatatcatgactgtattagtttcctaggactacaaaaaaaaaataccatgaactgactggtttcaaacaatagaaatttatttcctcacagttctgaagtctgcaaatccaaagtcacagcgtcagcagggctgtgctgactcagagggctgcggggagggtctctgtcagtactctggggagggtccctgtcaggcctcccagcacctggtgttgcctgcggtccttggctccttggcatccttgacttgcagaagtctcactccatccagtccctccctctagcgacatgtgacttttgccctgtgtgtgtctttgcatttcttctcctcttctaataaagccaacagtcatattggatgaagggcccaccttatttcagtatgacctcatggtaacttaaatgattacatctaccacaaccctgtttccaaataaggtcacattctgaggctccagaaaggacatttttgggggaagctatttaacccactatgattacaaattcttccaattctttatttgccctctctcacacattttatatctttccatctcctgctggacacacagtagacaactgataaatatatactcaatgagattcttaaaaaaaaaaaaaaagcatttttaagggaaggaaacaaaaagcagacagccccatcagggtagccaggagtgctggtgtgccaggtcctgtgggtccctgcagccctgtccccggcggcgccagcatccagctggcagccacaccaccagctgccgctgtcccagctgcaagtagcctggtctgtgtcagaacgggctgggggccagtaggggacaggatccaggcagtcctggaccaagcacaggggcggcaggcaagctgcttcacctgcatttcagatcctcactttcgggtgccacggtttattgggcatcttcaagtcctgtgtttccttcctcaaaaggaaaagggggaaatttgttaatggacaaacgactcatcagtttcccaagtgattagtagtctgaaaacatgtgcatgaaaaaattgcctcaaaagttacccttgattacaaaatcaattccaaacaaactgaatttttattggataaactgtcacctgtggttgaaacttcaacaactagattctatttgcaaagttgtattgactgtccaaggctcatgtatgggggaagtaatgagagtatttacagaatatttcagtgtgtgtagttcctgaaaatacagttattccaaaattaattccaaactaactgaatttttattggctaaatcgtcacctgtggttgaaacttcaacaactaaattctatttgcaaagttgcattgactctccaaggctcatgtatgggagaagtaatgagagtatttacagaatatttgagtgtgtgtagttcctgaaaatacaatgatgctgctgaaaatattggctgtccagaattggactttatgagcaacagaaaatccacagcacacactgctctgcagtagagcagagtcaaaatgttctttgaaaagaagctataaacagatacagtaaataagcaaaaatacacagatcctgtgtgctcttagaggtggtttcaggtttctgcatgtctttcattttgccagcagcgcacagcagggcttgggtttgcactcagaggagcctggctttgggtccctactgcacagttgtgagaccttccatagttaaatacctctctgtggacctgggtactgtgtttttataaagatgaagagtgccataactgcagtttcaggccaagtgaggtgctccatgaattggaacatagctaagtaattctggacctctaggtgtgcatttctctatagagcctgtagatagtgtggagcctgaagccagtgtctaggtccataccccatattcaacctggaccaagttacgtaaccttgagttagtcatataaccttgctatgcctcaatttcctcaactgtaaaatggaaataggaataaaaataacattatagtaagattgttataagaattaaatgaattaatataggtaaagttcttagcacagtgcttgacattaatgtttgtcattgtccttcttcttcttattattattatcattatcttctgtctaaagtgtttgtatcccagaaaccagaaggtcaggacaccgtggtttcaaaacaaataggccgttgtttgtgtgaggcttgttaggaagtaaaagaaaagtagttctatttaagaattgctaaaatgcaaggtatgctgaagaagtcatggggaaataatccaaaatccttcaatttcaacataaaagcattagaatgctattgaactaatagtctgtaggattttaaaataaacaactctttacttatttattaaaacgtttatttttcttaaatagcaaaagtatgatataaaatgacaataaggcagaatgaaaggatcttatattttgccttaaccatcacagctaaatcagagtatgtatttgcagtaaacattagtatttacattaaaatacttgtagcacatgtcagttattgaatagctaacaattctatggcatgcacatgtcaggttatacctaaaaacttctcgacaaccccattaagtaattgcttttgtcggccccactttacagatgagaaggctgaggcagagagagcttcagtaagtgacccaaggtcctttcttgaaattctccctctctagaagatagagattttgccttttcttaaactttctttcagtttcccatattatgtacgtgcataagagccaacaaatattgtcgactgaatgataacattaccattccagacacatagtagaagcttaatacatgtttatggagtgaatcttgaataagaaacttttccatgagagtggtggtgttatttccttttaaattcttcttaatgctttaataagagcttttgcttttctatatttttttctactactctaaaatcaaatttcacatcagcctctcctcccaaggcaaagagtgcctgtgttggccaatcaggggcagcctgggatttcatagctgacatctcctacgtgatgccgttctgagggaaatcgacatttcaaattcccagtatttattattcccaaaacaaaagctgtcttcttttattttcatgaaatgattttattgttggaaccacctacagctttacactgcagcatttgttaaaaagcaggacagtgcaagtcaaggcgaggctgacatgccgagaccttcagaggcgcgttacagcatttcctgatgcactgaatccatagccacaccacgagcctcagactttactttcagttttttatctaaagggttatacacatttggtgagcacagagtgtcaacctgccatggatagcttttgtgtgtgagggcatgttgtttcaaatagtgatcaatatgcttcaccaatttatgatgatggatctaagaatggtagaatttctgtgtggagaagcttcagggtgtctttttgagctggatactggagccctggaaaggttacatgggggaaagggatggcaaaaatgacagctgctgagccaatcagatcacccacacgcgcccatatgaggatgtaaatatcacctagatcagcctcccatctctatcactggctccgatttctcatcggagaattattttatagatgaagaaagcacccagatgtgaaaagtcacctgagcagtgaatggcggtgcagggactccaacctgggattttgtggtggttgtgtctgcactagttctgtgttcagttgaaaatttctccattactgtcatttaagcacttattctggataaggcaatgcttttaaagttgccattttaaaaattatatgacctgttttaaaaagacacaaaagagatagaaacacgccagatataacctaattataatcagtaggcttattatactgaaggaattacaaagacttatttttctgaaagaagttcattgaaaactgtacttcccaaaatgattcattttgaaataaacttataactgagctttacttcaatatcaaatatttaaaatatactttaatgcaaataatatgttgtatatctgaaaatgtttacctgtaatttctgaaaaaaaagtattatatataaatattgtcttagattgtttgggctgcattaacaagttaccatgcattgggtggcttataaacgacagaaatttatttctcagagctctggaggctgggaattctaagatcaaggaggtgggtagatttggtgtctggtgagggttctcttcctggttcatagacagctgtcttctcattttctcacatggcagaagaggcgaatggtgtctctggggtctctttttagaagggccctaacctcattcatgagggctccaccctcacgacctaatcaccctccaaaggatccacctcccgatagcatcacattgaggtttaggtttcaacatatgaattttgggaggcagggaaatagatcttcagtcgatatacatatttttttaatagatggaaatatccttaggccaatgtttcttgactttttggggggatcatggacatgttgagtaagtaataaaagctatggggcagtggatcttcagaagaacacaccagtatcgaaagctgcaacagtccaggccttttttgcttcctttcaaccttgtgactatctgcattccctcaccccccggctcccacttgtccttacccagattaaccagggattcatactccattaaaatgcctgatatagatgttggatcgtgtcttcctttttttcaacctaaattgcattttgaaaccttcagccacactcttttctctgatctcttatttgtcctggtttcctctgcttctttttatgcacacatttttttttatcctcctatgcccattgcattgtaccagtatctttcactacaattgttcttgtaccaggaaaagtaaagggtttttataaaaagccttcatcaagtcattttcaaactgcagatgatactaggaaagaaaggccatactgagattcccccccggctaattagatggtgaaatttttagttctcagcattgttatctgtttgaattgaaaccctatcattgaaaaagccaaatgaacttgaaattgaggagggccatttcccaaaacggaacgcagccaggctgaatccctcggtggagagccagggagcacgaggcccggatgcacgtgactcgtttccacagttctgatttccaagcgaagtaatttgttctttaaaaaagttattctaggattcaagactttaaaaaaaatctgtattgccaaatgcttaccatgcatgatgaaatattgaagaaaggtgtatctcagccttgcaggtaatttttaaatgatccacaaggatttattcaaggtcagtaaattctgtgttcgaactttccatgtcagtctgtgtcccacactgtgtccccatcaagtcaattcctctgatgctgaatctactctattccttgcctctaagtaaaaaaatttttaaaaattaaaaaacaaaacaaaacaaaaaaacaagcaaacaaaagaacaatacggcaatcgaagtctcaagcatttcctcttttactgaattcgacacaattccatcgctaagtagagaaaacctgaacatcctattgctggccgtgcctcccagggttctccagtaaaccttttccatgaaagcctgaagtccatttcagatgcaaaacatgcagaacctctgggctccgcgaggcctgatgcatgactttgataggactctgcacatgcttagttgatggtcctgaacatgtgtattttcctgaatttcttgtgctttttttactggctttgacttgttgacataagatgaatgtttctctcttgttttatcaaaatatttaagtgtttttagttttgtattgagatttttaaaaacaaagcttttcttgctagtaaggatatggatgattactttcttttcaagaaaaatggtgaaactggaaaagtaatttcatgtatttaaaatatacacttgttgcatagttattgatcagtttataaattttacacctttttggtggtgggaaaaatatattcatagtgacttctatcttaaattctggatctaagacgatgctgctttttactaatagtggctatagagtatatgtgttcttgtaaaatggttatgcagaaggagaataggaaggactatagatatgtgattaaagatatttctcttttgaagggttagttaaattgaggaggcggcacgagggacaaacattgtaaactctgtgtaacagcaaggatattcaaggtgacaaggatcagaacctctgtgaaggttcagtaaaattatttgtgcacatcaggttattatataggatgtaaaaatccagttttatggcaagatttatttgtttatttgtgactaacatatacgacctgaatttaaaaactagaggcaacactcatagcaatttagaatgcagcttttcttgtgatttaaattggacttatttttctttagtctccaaccctttcttagaagaattatggtggaacagaagctgtaaattagggacagttatttgaacctagttacagaaacgaagttattggcgtggggattctataggagggactctacattggatggaaatgaaggaataactggaagaagaaaggagcaaataggcccaagtatacatttcactgtgtgaacccataattctctctgatagctgcatgattaattcaaagatttattgatttttcccttctctactccagcctgctgacctggttttgttgacaggtttgtgtggatcaagccaatctgacagatgaaagtgtgctaccatattagtccccgtggtctggggcaaatattttatacagtgtccttatcaacagtaaccgaacacatgtgaggcatccgtcaacactccttcccatgccatgccatgaaatagactcagagatgccagccccacagcagaagcagctgggattattcgttttaatgaacatgcatcgtgtgtacgtgtgtgcgcgtgcatgtgtgtgtgtgtgtgtttatataatgaggtgggagtgtggaagttatggcatttttactcttagtaacaaatattaactgacagttagcttttaaaaatacctttatgggccgggcgcggtggctcacacctgtaatcccagcactttgggaagccaaggcgggtggatcaggaggtcaagaccatcctggctaacacggtgaaaccccgtctctactaaaatacaaaagattagccgggcgtggtggcaggcgcctgtagtcccaactacccgggaggctgaggcaggagaatgccatgaacctgggaggcggagcttgcagtgagccgagatcgcgccactgcactccagcctgggagacaaagcgagactccgtctcaaaaaaaaaaaaaaaaaagaaaaagaaaaagaaaaagaaaatacctttaatgatacctgagatttacttcaaaacaatccattgccaggggtgaggttgtagcctgaattgataatttctgaagctgggggatggtacatggaggtttattatactcgttatatccttcatgtgtgtttaaaatattctataatgaaaagttgaggaaaaacacctataagacaaatcatattttttacttgaaacttcagattacatgtttaaacatgagcaattggcacatgaccaagccaggaataggcagattataaatgtcatattttaaaaattaatgctacaacaactgaagcatttttctgttggttatgagctctaaattctggccaaagactagaaccacaaataaaatggtcctttaagactagtgaatcatctccaagttgagtgtattccttctcagctaataaaatgagatatttttgaccaacatttctcaaactgtgtccatggagagattaggaagatagggaaaagattatgtggattctggttcaaaaaattttaggaaataatacattaagcaatagcaacccagttccatgcagcacgaatgtcaaagtgattgtggccactttttaaaaccaattaaattagtttatttttatttttattttctctttttagatgtattagtccattctcacattgctgtaaagaaatacctgaggctgggtaatttataaggaaaagagatttaaccggctcacggttctgcaggctatagaggaagcatggtgccagcagctgcttctggggaggcctcagggagcttttactcatggtggaagtcagagctggagcagaaagttcacatggtaaaaacagaagcaagagagagtgagggaggagctgcatacttttaaacaaccaggtcccatgagaacttaccatctgaaaaatattgtggatagtgctaaactattcatgggaaatccacccccatgatctaatcacctccccaggccccacttccaacattagggattacagttctacatgacagctgggcagtgacacagatccaagccataccaccagaccactcatgttattctatagaatataatttagaaaaaactacttccaacgtaaggccactagaggtgatttgcataaaattgaggttgtttaaggccttgagttcaacaattcagggttaaatatgagttagatgttttcataggaccaaacaacatttataggtcttgaataaatctgaaatttctacttttataaagtctaatatgtagatacactgggtttcattggattctaattccattttttgtattttggggggggcatcatttttatctttactaccgtaaaacaagacaccatcacagccaactccaaatggccagctgtgaagtggaaggaaagatggaacaagaggcaaccaaccatgtgtgggtgctcaggtggaggggactgtggttggtggaagacccctaagtggagtgagcttggatagggagtcaggatgggaggtggccagggaagggatggggcagggccagcctgcatatgaagggccttcctggttaaggcaatagctttggatttttatgcagggataatggcaaactgttgaattctgggctggggattgatgtgactgctgttgctgtgtggagaaaagtgcgggggagagcaaacataccattagatgactagtaggaggctggtggagactgacttgagtggcagacatggggacagagaaaaaaaggacagatgtgagagatgtttggggaagctttggtatgttggctgatagattagatgtgggggtgagagaaagacagtcatcaaggatgattcaggtaaggaatttagtgcatgttggtaccatcaataggtgtggaaactctattatttaaggttatcaatcagaaattgaatagcattaataataggcaaagccctttaggcactctgttcttggtgtatatgtgtgtgcggaggatgtcctgtgagccacttaggctcactataaatatctttctgaagccttccttgaatatactactctggcctcctacctttgctcaagctgttttcttttttctgtttcaccttcagctttatcttactcatgctaggtcagacttatcactgacttcactgcatttttgttggctgatttccagttagtcaaaataaaagaaagtggatagttttggcctttgaagcaaaaagagacacagggacctctctttccagcttccaactccggatatagcagttgatggtcgacatctcacagtaattattaggcactataattttgctaaatttacttaagctaaactaaagaccaccaagagcaccttctacggactgatgttatgtccctctctaaaagccatatatgttgaagccctaacccccaatgtgactgtatttggaagtgaggcacttaaggaagtaattaagattaaatgagggcatcagggcagtacctaacccaataggactggtgtccttataagaagtgggagagacaccagagagcttgctctttctctctctgccatgtgaggacacagaaggtggctgtctgcaagtttggaagagagccttcaccagatacacagtggctggaaacttgatttcggactctggcctccagaactgtgaaaatataactttctgttgtctaagccatcctgcctgtggtattttttgcagcagcctaagatgactaatacagcacccttctgctcttctgtctgactgtggtttcttggagaactgctgtcttatattcttcttacttccaatggtcattcaatttccatacggtttccatgtagtctaatgtcagttcatttttataaatttaaactatttttccatttttcccatagtcatcctttttttttttttttttttgtttaaggaatcatcttgctctgtttcctaggctggagtgcagtagtgcaatctcggctcactgcaacctccacctcccagtttcatgcaattctcttgcctcagcctcccaagtagctgggactacaggcacacaccacccaccacacctggctaatttttgtatttttaatagagacggtgcggggggggagtttcactatgttgaccaggctggtctcgaactcctggcctcgtgatccacccacctcagcctcccaaactgctgggattacaggcatgagccactgtgccaggcctctttgttcatgttagtgtatggagacttttttatttgttcaggctagtctgttcgccttttcttcctttgaagaaattatctgttctccttataagttttacagtgttcaaactttggatcatgtctttttctctctttgatctctttctaaatatccctttatttaaaactgtgcatggattttctcctaaaatcatgtggtgaggaaaatgaacttttacatttcttcaggaaagtaaacctggtcaaagactacagttgggagaaattttagacactcacgtatgtgactagactgtggatgtgaatggtgtctcgttaagcttgtctcaggctttcatatggcaaagtagtatttttaagttctttttaggtcctgcctttacctcaggatgcattttcttataatctgattacaatattttttaatggagactattttctcttgtacaagttatatgacaaaagtacatttggcttgtcttctgtttgtttgagttgattgtgttctgattaggaatgctaagtcacctatgcaaaagcaactgagaactaacttaaaaacatgaattattggggaaatgtttgtacacccatgttcatagcagcattttttgcaatcgccaaaagataggaacagcccaaatatccatcacccaatgaatgagtaatgcaaatgtggtacataacattccctggaggatttgtcagtcttgaaaagaaagagaactctgacatatgccacaacaatcttgagggtattacgctaagtgaaataagcgtgtcacaaaaagacaaatactatatgattccacttatatgaggtatctaaagtagtcacttttttttttttttgagacggagtctcgctctgtcaccaggctggagtgcaatggcgcgatctcggctcactgcaacctccgcctcccgggttcaagcgattcccctgcctcagcctcctgggtagctgggactacaggcacacgccaccacacccagctaattttttttttgttttagtagagatgaggcttcaccatgttggccaggatggtcttgataagcagtcaaatttacagaggcagaaagttagaacggtggttaccaggggctggaaggaaagagaaattgagaaattgtttaataagtaccgagttaacaatactgaactgtcctctaaaaatgggtaagatagtaagttttatgttacatgtactttaccacaaataacttaaaaaacgtattgcacctcttctcttaaaatagctgcatgggaaaattgattttatttgtaagtaaagacctaggtgaattaacttgaactagtactatattgtgacattgtattttataaacaacttccaaaatcataatcataattattttgtcctggtatttttttaaaggatgtgtgtgatggtattgaatttggacttttttttttattatagccatatgttgaaaaaaatcaagccttagaaaatgaaaagtatattgtaggcttaaaaattataataacatggtcgggcgcagtagctcatgcctgtaatctcagcactttgggaggcctaggcgggcagattacctgagttcgagatgagccctgccaacatgatgaaaccccatctctactaaaaatacagaaattaaccaggcgtggtggcacacgcctgtaatcccagctacttgggaggctgaggcaggagaattgcttgagcccgggagatggaggttgcagtgagccaagatcaagctgctgtactctgacagagcgagactctgtctcaaaaaaaaaaaaaaatatatataacaacatttgggaaaatagaatgatagtaattttatctgtctttatattctttaacactttggtgactgaattatagacaactagtgtataagctacaggaaagcagagattttggtctgttctgttaatttctagaatagtaactggcacataggaactccatgactcttcatttaatgagtacacgttgagagtatccaagtactaattactctttgggcacgtggattgtggaagtgtggagaccagtccacagttctcctagatataaggagctttccctgtgtctgttgatcacataattattcatcagtgagctctttgttgcttttgtatcttagggtaaataatttaaacagatcatatagataagacactgaaaatctctccactgagaggtggagagattcgtctagggtctcaaaataaatgactaacagaattgttctctgttcaggacactaagtgatgcaagaaatatttagtgaccaccgactctgtgaaggtcttgagcttggctttgtgaatatagctatgaataagagaaatacgcaatccctgcactcaaggaatttattatctggtgtgtgtgtgtgtttggcacggaggtgatataactgcttcctgaactcaatacaatcttttcattacagagcctcattttagccccaatttctgtatcttttctttgtttttttcccaatcactatcttttgactggactatactactgaaaggaagtggagtccttaggcatctctgggtggtctggagtgatctcatcttccaggaaagctgttacacagacgttagtttctgaaaatgatatgacatgcagctcactgtaatacaatctattaattcaacagataaagttttatgttctaatctcccagaatagtacttaaacagtttagtgcacatgaatcacccaggaatcctgttaaataaagcagattctgattgagtagcttggtgtggggcctaggattctgcatttctaatgagctcccaggtgttgctgaatctgctggtccaaggctggtattgtcagtgacaaggctgcaggttcttagccctggttgttcattacaaccccctgggtggatttttacaaataccaatgcccttagagatttgctttaattggtctgggcttgggctccagcattcatattttgaaaaactttccaagtgagttttatgttctaccagcactgaagaccacttccctgcacaaacacaactgatgctgcctgtcattgtgtgtaactgaatccactgatgtgagttggtgcatatcagtaccttttataaatgcaaggaaggctggaggctggggaaattgtcataagacagcacccagtgcagggactagtgtacagcagtgtgtttgctgaataagtgagtgaggcaacgagtcattttcagacactgtagaggatggctagtgactggatcccagtgctgttgcctggagctctagcaactgtatttggtatctctaaacatgctggctatgggatagcagagttaatagaatgagactggggccttctacttccagataaaaatttggaaaggtattagaaggaaggtactggggaaataagttttgatctatgatagataagataattgaaaaccaaaccaaagaaattaaattcagagtggagaggtgtattagtccattctcacactgttatgaagaaatgcctgagactgggtaatttataaagaaaagaggtttaattgactcacagtttcacatggctggggaggcctcaggaaacatagaatcatggcagaaaacaaagcaaacacatccttcttcacatggcgacaggagagacaagtgccaagcaaaagcggggaaaagccccttataaaaccatcagttatcatgaggactcactcactatcacgagaatagcatgggggtaactgcccccatgattcaattacctcccacctggctcctcccacaacatgtggggattatgggaactacaagatgagatgttggtgaggacacagccaagccatatcaagaggcataaatcgaaggtagccttccagggactgaggtcagatttgtcccaagttagacactttgggcacatattttcaacagacattccacaaaatatgcaagtatttattttttgatagtatgtttaaatacaaatagaaatcaagccttaaaaatgactcgctgatgaaactacatttctcctgctcgggactgcatttcagatactgtccatttgcatctgggtccatgatgtgctgttgaaataacatgaactcagcttgtaggtgaaggtggggagggaaacatgcatttttccatctgaacagaaagtgtgttctggcttttttctgagatattatttttattgaattttaagacccacacaggaagtggctttcacttggtttcatcttcctgatcagtgcatgttggggacaaaggagagaggagggagttaacctggataagtctgctgcttcttcgggagagtggggcatcccaccaacctgctgcccatgttgctttgtggggatacatgaagcagcttctagaaaggcttctctaggagcttggtgaggctgtgcaatgccttttttgcaaaacgcttgctgttcactaatggagcagatgaaataataaagccaaccaaggaagcaacttaatggggaactaaccagccacagtggcttttggaactcttgtgccttgctgcacatcactttgaagtagtctgtggagtccatgcttctgatccttggaacatttggttcatttttatgtcattgttgtctagcgctaaccgcaactggtcccatagacctgaagtagcccaggtgcaggggcaaagcagtggccaggtgtgagtgctgagggcctaaatatttcaagtacaaaacgcccaggaaaacaaccaccgggggctttaccatacttataaaaaggaatccttccctctgaaagcctccagcctgactgtaggcagaagcagaagcagccattgcccatgcaaggtgaggaagaacaggtgttggtgaacagagtgggctcaggtcatcatttgtgtggcaaaattctatcagggatgaaagtatcagcaatgggaccacctggaacccaagctctgccactttcttgctatgtgatcctgggtaagttatttagcccttctgttccgcggttttctcctctggaaaatgatgaggatgatactactctgctcatagggttgttttaagggttaaatgaggtactgcatagaaaacactcatctcagggctgggcatgcacagtgcatgggtgtagctatcatcatcctcctcatatttagaatgcttttctgtggccacccatcatcagtatgtgcctatcttcatcagcagtgaagaggacagaagcttctttctcccttcctggcatgctggagatgtggttggtctcctcaggttaccattaaattgttggcagtccccactgagagtagggatgcagccaactccacaggcacctgaggagctggccctctagcaggtgtcagccaggagagacatttaccaaactgaagttggggaaaagcctgagctgattccacactctaagtcaccttagggcccaaagaacaggtggcatgagatactcagggaatgctatggcagcgtgcctaaccatggttctgcaatcttcacacccgaggtcatggcagcggacaatttctgtcttctggataagatgggggtgtatctgtctgtgagcattcattcactgattcattcaaagtggatggattgggcattgccatggaccagacccggcacagatggggtgcccagggtggaacggtgagcagtagtgccagctgtgtctgtgctcatgggcctatggtcttggggaagacctcaagtaatcatgtaaataatgacctgcttacaattgtgagacctgctggaaatgaacaacaggagtgggggctgtacggggaatttcaggggacctggcctgtcagaggtcagggaatttatgccctggaaagtgacaagttgtcctttagattggttaaagaaaaatgaaagtgcggagaggacattccaggcaaggggaacaggtgcagtgggcactcacagaaggccaaggggacagccctgttccacaacagcctgctcagagtccagtttgctccttgctcctgattggagatttttcacatactgtctcccagcagaggattctgtccacaggtattgacagggcctggctggtctcttcttgtcattcaagttgtagttcaggaaggatgcacccagaaggctgcttttgactactcactctgaatttgccacctccccatgcccagcctgcctctgtgttttctttgaaattctgccgttcctttattcctttgcttgctatttataaagaaaagaggtttaattggctcccagttctgcatgctgtaaaagcctggcaccaacatgtgctcagcttctggtgagggtctcaggaagcttgcaatcatggcagaaggtgaagcaggagcacgcacaccacacggggaaagcaggaacaagagggagagaagaggaggttccagactcttaaacaaccagatctcctgtgaacgaactgagtgagaactcacttatcaccaaggggatgggaggtccacctccaggacctggtcacctcccaccagaccccacctccaacactgggaatcacatttccacatgagatttggaggggacaaacatccaagccctatcacctgtgtaccatttgttgcttctcctctgaacaaaagtcctcaaaataggttcttcgtcacatccactgttgtcccttattttcaggacactgtctgacaatctgacaaggaagtagtgggcactccacgtctgtggagcaatggacagtggctcccagtctggccaaatttccctaacatgaaagcatggaacacttcctctcacaggtcaaacgcgtggaatgaatttgcaatgcaattctcggcacagctgactttccttgttgcttctgctggttttgatcactttccctggggtgctgtgccatcaggagcaggggcctcctctttcctctcctgtcggtcctctccaagtgatctgcaacttcatcccggggggaaacagggcagggaacttcctcctcaatttctgatattgcaaggtagcaaactcacacaggccttgataacaataaatgaagagtcaggtctttacaaatatgatgagaaaatacaatggaagtcccagtggggagtccccacttactccttccatgccaatacagatctccctacagactttaccactggttctatatatatgcgatgccagtgggaaggtatttctcagccgttagaataatccatttcctttatcccggactatggataagaggacatttgcaggagaggggagacacttaggaagaaaagactggctttgtgaatagaaatacattatttgtgcatatgttgtagctcgactagactttgagcagactgatatctgaaaacatatttataagcctgttataaactcataattctaaaatattgaattttatttattttgcatctataaactgagttttgaatttgtgcagtaatttgcattattcagaactcttgattgcaagtgacaaacagaaatcaaaaaaaagtcttattggctcacagaactgaaaactccaggagtaactgccttcaggcccagaagcatcaaggtgtccagaaactctgacaggagcacctctcactcttgctgtcagtcttactgctcttggagtactctggtttagattggctccttggcatacctagcatggcacgttgcacacaaccccagtgacagtagctcagtagccagggggaaagagtcttctttctccaaaatccctgagaagggtcatgtcacatgcctatctgtgaacgagtcaccatgtctaggggcacagaggtgatgaccttggtctcatgcccatgagggatggctcctcaaaggaaaacccaagtgctcttattctaagagggagaattggatgcccagagacaaagtctatagatgtacgtggtccagtgttgaagcggtgggaggagagtgccggcaacacaggcaattccacgttgtgtgcgactggcctgtgcatatggaggtgttcagtgacctggccctggacactcctgctaacaggacacacacatactctcttacacacatacatgtccacacacaccacacacacacacatatacaccccccccacacacacactttgacatacactcacatgcttatattccccccacaccatgcacagacatacactcacatgcacatatgtcatacacacaccacacacactgacatacatacacttaacatgcatacatgcacacaccacatgacatacactcacacatacacaccacacacatacatactacacatactggcatacacacaggtgcgcacacacacacactcacatgtgcacacacacacacatcattgacaactatgaaaagcccctgcatacctcagagcccctcaagctgggcttctgatgacacctcaggcactctcccctttttattttgtttcccatttacttcctaccttaccctgttcaggctgccgtaataaagtttgatggactgcgtcgctgaaactacaacagttcatttctcatggctctggaggctggaagtctgagatcaagatgcccgcagggtgctggtgagggccctcttcctggtggcagaagccgacttctccttctttctttgcctggcagggagcagggaaggaagtgagtggtcttgtggctctctgagggcactgattccattctgccccacctcccatagcatcatgttggggaacagggttccagcatattaatttaggggacacaaacatccagcccctaacacttccattctcattaattgccttcaaagagagctaagctaatcctaatggtaactttggcataaagcaaaactttgagaagatgacatctgatatctgctgttcaatgcatgcttgttgggagaagagtgttaagatttggactttgcgtcacttatggccaaaataggacgctcctgtatgtctgcacttgaatttaaatatgccagtctcaatataaagcacggaactcatgctgtttaagcaagagcacatattaaggctggcatgtctgtcaagataataattttgatagaggattaaaaaaaggaaaaaaatgtagagaactgaaggtaaaagatagccaggattagacctttcaatattaacagtgaactttctttagatatttcttacataatcatcaatgcttataaattctagtgcttctgtcttttcacagtgttgtgtttttgtttgtttgtttgtttgttttaacaacgtaatgtgcttattcctcaggcttcaggtaacctctgtaattacacacccagtgctgatgcccacgggctgccacaaggctgggcatgttactttatgctctaaccctatgtgttcaataagtactttgaaaaaaataatatcttgctaggcatattttaaatcataaaaatctcaattttagggttttcttccctcaaatgttaatttactatattatttacacttatttgccaaacagggaacttttgctcaaagaaacaggtgcagttttagaagctgaaattaaacacctctctattctcatattgccttttttccctttggacacgccccaaagcagacatcctgcttacaaaagagagcttaatggcctccctcctgctctccctgcctgaagtctttctagaatttggaaatatgtccattttgttagggcaatctgttagtgttaatgattttatcaatctaaactccactaaaagaagcaaatcaacacaatgctaataaattctgtttgttttctaatcccaagaagacacaataaattaacatacatttttaattttaattataaaacctttcaaatagggatgttgtctctcttatcctcactgtcattcttgtgcctggtacagagcagatattttgtgagggttatttttgttgtcgaataattgtattttaaatacacagaaaaggacagagagtcacaaaaacaaaaagcacgaaagaaaacaaaaaccaggtacttaagcccaacatagagtcagatgtttatgctttgccacatttcattcattcctttttttatgaatacgagtgttagatagaattgaggtcccactcacattttctatacacatcttgaaacctctgcaacgtatttgtgaatctgtaaaccatagaaactaacacagtgtatttttcaaatgcatataaatgatatcgtgcatgctaagatttttcttagatttcctataaatcatttcaatcaaactctccctacttttctgtggaaactatgtaacaaaatgctctatttccggaagcctccaggccaagggtgagtgagcctggggtgttcaaatgtaatcagagtccaaaacaggcccttgcttgggctcaaactaaactgagttaagaaattagcctggaagggagagaaggtgatgtcagatcttaataggataacattgccatgagttctccttgcaatagaggaggctgcttttcttcagcagttattgagatgtatgtttcttttttcactaaatttctgttattgtcggttgattttgaccacaggttgttgtcttattgtcttgactgtcaaggacatataatggcagagggattcttaggtcagcagacatgctctcagcttaggcaagcctcaggggctgtatgtgtttcagaatttctcacattttagatagctatctaaaagtaaatgttaccatactctgcatgttttctacaccctcacggtggaatgtggggcagtaatgcttcaagatttcttcagcagaactgtggaatttttattctgtgtgtaatgaacaaggctcaaatagaacctcacgtccatttgggccatgttttggcagcaggtgaatcatgaaaatactttttcatttttgaggtatttttggattgtgggattgcagataagggattgtagatgggtgttattgttgttgttacaatataaatttctataacttctggccagttgttagaattatcccttgtttttcaatgttgactcctatccctccctacctctctccctcctcctttgatttcttctttcctgctttccttccttcctttctttctcttgtcatttctttaggatttgaagagagggcacagtatacgatctttaaggactcagattttcaagttaagcatatctgtggccaaattatctttctgctgctcattaactgtgtggccatttttctatgtaacttcaggagtttcagtttcctgagataatcatatctacctcctgtggttttgggaagatgcagtaaggtgatggatgtcaaaacatttaacacagtctttagcatataactagcacttgatagatgaccactgctagtattgctgttgtcgttaccatatcacacagcatgcaccatttgctattctcttttaagcaatgaatttattcacattcaatttcttgaacatttttgaaatgcatctggtcttcgcttacatgtatgttatttggcaacctgtctgaaaatattattaattatggtttctatcgttggctttagctttaaatgttgcttgaaggcccctggcacacagccatgcttgaccatgtgaggaacatgatgctgcccccatcaggtacagcctaatggggtggatggatggatcgatcgatagatacatagatagataatagatagacagataggcagatagacgatagataggcatatacatagatagatagataattggtagatatgcagaagaaaattagatggtagaaaggcagatagatgaaagatagatacatagataaatagataggcatatacatagatggacagataactgatagaacacagatgatagatagatagataatagataaatagtagatagatggatagtagatagataataaacagaaaacagaatagatatgagagagatgatagataactagagtgatagagagatgagagagatgatagatagatagatagatagatagatagatagatagatactcatctgatcaccaaacaggtgtgaacagaggatgttttaaagtgtgggattctgcatttgctgtgaacaggagtacaccagacaatccttctataggaggaagggaagaatgcatggggccaaggttttattttgctaagaaatcatagccttcccagagtttaattgcctccatttttatcaaatagttagaaacacgactattttttttgacccttggaggcacattggtgacatctgtgggggcagcgttactgatggttgtccgtctgtatgttgctgagccctgcaatcctggtatcccaagatgcctcccctcttccaaagaagcacttaagagctcaagttgattaccgcaggggcttgaagacgaagcctcatttgcccgattatcagaacagatgaggtgtgcacacagcctttgcaactttccattcatctcaggaactaaaatgagtaatatttttaagactaatgtcttaaatttatgattttatttgattctttattcagcaatttgaatattatggttgattacaagtacataataagagcctttctgtgattggcattttcatttttctaggtaaataaagtacctcttgatctgtttttatttttcttcctacccccactccccccatcaattttctttcacttgtgtttctctacacatactgtgggcatcccaaggggaccgtagtcttcttgttcatgtttcagacttgtaagtcgtatgcaaatgcagccatattttacagattggcaattttgctataattaagcttcatgaatatgaagattcttgtagaattcccaggacgccccatggtgaggatttgcaatgaaatttcttctcagctcactgtgacctattagagtgtcagtttggctcagtttcaacatggtgtttactcttatgaagtgcaaaccacttattagctaatttttaagccatgacagaagcagcctgagaggcacatttgtccagagggcttgacaaaaagctagaaggtcagtgtcttcacagacccactgaggttcagaaattaaatgataattttgtaaaccaggcaggaagtgacatttgtgcaattgcctttgatatgttttctttggctgtgtttggtttctttgtctctgcagaatctcagaatgagccagcctctaactaaaatggcgctgcttcatcttaaaatctctttgtgacagcttatgacaggagatcccttggaaccctggttctctgtgggacctttcctggactcctgtgtctgcaatacaaatgttaattctcagctctattaatacctcaatatcacttaaaagatatccaagggaaactttacctggccaatttctttccacaaagtagcatttctgaattggagattgctggttggctcattcttattttatttacttttgtaaacaggttatcatttataattcaaaactcaaaaagcatacagaaaaaattctagtctcactccagtcccttactctccattccctggtatgcctcccccaccctcaggtactaatagttattcatcggtatccaaccttccagaaattctcttgtatatacacaaaacaaatagaaatgtatcactttgtaccaccagtactttagaaatcatttcagcatgggtactcctgcggggtactccctgatcagattgccgcgttgtggaagatttctttctgcctgtcaattttatttccagaaaatagtggtcacattgctttagggtaagtcaccaaagggtgtagctgcgcctgtgtctgtgcagccctctggtatcctgttctcagctgaaaataaagccctggaattggtccatttcactttttctttttcttgcagtttgaaaggcacttgaactagcccactaatgttgctttttactccttttacattttaaaaggagtcgtaccctggtttatttgcttttattgcctgtgaaaatggcctgagtaattagaccaacagagaattgcatcttaagggctaattattgatatattccttgtgtcagctcaaaagtaacctctggggatagaagattaggcagagtatgcctgcccatgaatatacactgttcatgcctctctaggcttcaacacacacaaggtcatgtaaggcaaccttacctaccccattagggtccagaaagatatccacctaggagagagtgtaaatatcacacccatcaactcactcttatgcccagtggctcatcctttcaaacatgcaaaactttctataatggggaatctgaaatactttaacaagtttaaaaatctttattgagcacagattttgatttttaaaaaatatttttgatagacatactatggttcaagtcccatacttgcattaaagggttaaggtggaacaatgcttcatgcacagttagcatttcatattttttgtccagtgaagaaaagaaaacattctcaactttgatctcctttagtttaaaatgagataagataagatacactccagcatcatgctcttacttaaactgagctgattctcttgatttctatttcttgctttcctcgccattggcctgaaatgagtaggcatgacaatttttgtccatatgttgtatgtaattaaactccagcctttacattgccaccatcaaagacagcgaggaagagacattttattattgcaattcactgtcttaaggtggaagcttctgcaacggtgacacagaagcgtgatggagaaggcacaaaaatgatccatcttgctcttttaagagaggagaacataccggacttgtgcagacagaacttttttttttttttctattgaagcatcttctagtgcatttaagcttttttcttgtcaacttgaggatggagtgaagaaataacacacacagcttgtttgacagtgtggctattaatgaagcaagcaacaacagctttcactcatgcacaacagggcttggctgtgtggtttgcaaaaagcgatgaacattttcacattaggattttgaaggggctggtgaggaaactaaagatcatcagcatttgcgtgtgaaaataaaatggaaacgttaagaaaggttgaatgtagccttcaaaagggggtagaaagaacaaaatgaaataagagttgctctggtttgaatgtatgtgtccccccaaaattcatatggtggaacctaaaacccaatgtgataggactgagcagtggggccactaaggaaatgattacatcatgagcactctgcttccatggatgagatgagtgctttatttttgttttgttttgagacagtgtctcactctgtcacccaagctggagtgcagtggtgcaatcatggctcactgcaacctccacctcctgggctaagcaatcctccagcctcagcctcccaggtagctgtgactgcaggtgtgcaccaccacacctggctaatttttgtatttttcgtagagatgggatcttgctatgctgccacgctggcctggagctcctggactcaagcgatcccctcaccttggcctcccaaagtgctaggattataggcatgacctaccatgccaggtggattagtggtcttaaaaaagaggttgaatagtggctcatgcctgtaatcatagcactttggaaagtcaaagcaggaggatcacttgcatccaggagttcatgaccagtattggcaacatggcaaaatcctgtctctacaaaaattaaaaaaaaagaaaaaaattagccagacatggtggtgcacacctgtagtcctagccacttgggaggctgaggtggtaggatggcttgatcccaggaggtcaaggctgtaatgagccgtgattgtgccactgtgctccagcctgggtgacagagtgagaccctgtctcaaaaaaaaaaaaaagagagacagattgaagggagcacaatagcaccttttgcccttctcccatgtaaaggtgcagctatagggtgacattttagaagcagagaggaagccttgcctagacaccaaatctgtctgtgccttgatgttggacttcccagcctttagaactgagagaaataattttatgttatttctaaatgacctggtctcttgtgttttgttatagcagcacatgtggactaagacaagcatgatattttaggttccttaagcagggtagagaagagagtcagaatcctaatatgtctagttgctgtcaagatgggtgcatgagtgtggcacgctgtggactgtgcactgcaagaaagcaggctccattttctctctccttctctggctgcttcggaatctccctaagctagctagtgattacctagtacaaatacgcatttccagacgtatctccctgtctagactgagagtatctccacagctgagggggtatccttaacccctggtggaaaatctggtacttagtaagtgtggcaggcagagtaatggcccctaaagatgtgcgtgtcctaatttctggaaggtgaatatttcaccttacatggcaaaaaggattttgcagatgtgattaagaatctggagatgtgattaccatgaatcacctggatgggcccggtgttgttcaagggtcattataagtgaaagtcagagtcaggagagtcaagttcagcatgatgagatgtgaggaaaactccgccaggcactgctgactttgaggatggaggaagcagccatgaaccaagaaacagggatggcctctaagagctggaaaacacaaaacacactttctcctcgagccttcagaaggagcacagtcctgccaacaccttgattttagtccagtgagatccatttaggattttgatctctaaagcatgaggtaacaaatttgtgttattttgtgccaccaggtttgcagtgatttgttaccgcagctgtaaaaatttagtgcagtgaacaatcaaaatcgaacagcctcttgcttcacatgtgccatgtgctgacatcaaagaggtgctgagaaagtactgctattgattttgtactagcaccagaaagcagagagcatgcttctaggactcaacctagagctccatttctatgctcttgataaacaacttccatctgcatatttgggtccatttccctgatagccaatatgatttttaaaggaaaacaaaaatatttttaccagacagtaatatcgtattggtgattgggttaaaaagctaacagtttttcatgtatgtaatgggtgtgaggtttttctttttttcttttttctttttctttttgagatggaatctcaatctgtcacccaggctggagtgcaatagtgtggtctcggctcactgcaacctccgcctcctgggttcaagcaattctcctcccttagcctcccgagtagctgggattacaggtgcccgccacaatgcctggctagtttttatagttttagtagagatggggtttcaccatgttgcccaggctggtcttgaactcctgacctcatgatctgcctgccttggcctcccaaagtgctgggattacaggcgtgagccactgcgcctggccaggtatgagttttaatccacaaagacggcatggttagaattgaagttgtatttttgtatagttcaacttaatttgtaacatatactgcatgatgccaggtggtagaatcttaatttcatttaattcacgatgatcacagtcaacgcggggtcttctccactctgtgtctgggtgctttcctctgtgtttaggagtctaacctggggctaaaggatctcagcagaccaagtagagagggtgtggccttctttccatcactgataccaattcacggccggcatctgcagctaccaagtttccatcattgagtcagattgcctctggcctcttgtgtccttaactattaatataaagcctctccacaaaaggctctttcaacaacatctatggccttgtgagacaccctgaaaatgcctggctgtggaccaccctctccagaggtggaggaactctcttaggctgttgtaggaccatccacctgggcacatcaaagcagccatcttttttctactgctccaagaccgtgtcgttaacaggaacccatgtggaaatgttggactgtgttggagtttcctgagaccaccccttgggttgatgatttgctggagagactcacagaactctgaaaagctattgttgttaaggttatagtttatgaaacagtgaaaggatacagattaaaatcagcaaaggaaaaagtgcataggaaggagtccaggaaagaccaggcacaggcttccagttgtctttcccggagacctatagggacagggcttaactcttccagtaagaagttgtgacaacacatacagagtatcatcaaccagggagctcatacaagccttggtgtccagggttttcattaggggttagtcacatagagtgctcagatgacttaccttaacacttgagtctccaacccctcctccagaggttcaactgacacagcgtggcccagggtcccagaagaataaaaacagacactcgtcataatccaattgttggcataaacaatcttgcctggccccaagcctcaggtctgtaatgacacttttatcaggctggaaattgcaacagcttagaggttacctcctaggagtcagtcaagggcaagatctttctttagaatgtgtgggatttggaccccctaagcctgtgggattaaccctttactgcacacaggcctagattccctgggctctcagctaagcccaaagccatgtgtggtttccactgtgtctcctcccattggatgtgcctcctgtggataggtccttgactcagggcttctctgctgttagccatgggctcgttattcagtctgggtggaaaaaaatggttctggctgatcacatagcttttggcatctgttgttcatgtcatcaactaaatgacatgacacagagattaggcttttgaagctcaaagcaggattcttatagctagaagttgtttttttttttttttgttgttgttgttgttttcaaatttccaaccttaattttaacttcaggggcacatgtgcaggatgtgcaggtttgttacataggtaaacaggtaccacggtggtttgccgcacagatcattccgtgacccaggtattaagccccacatccatcagctattcttcctgatcctctccttccctccacccccacccttcaacaggccccagtgtgtgttgttcccctccatgtgtccatgtgttctcaccagctaaaagtaacttgactttctcactcctttataatcttttaccttttcccctgagaaaagaatgccaccaactaaatggggaagtatggccctagagaacagtgctgaggtcagcaggtggggccagcagagaaaaaggtgggggggctgacctcttttgtgcctgtcccttattaaggaggaaatcctttcccagaagtcaccaacagattttaaaaaatgtctttatctcattgaagttgggtcccacttagactaattcctggcagaagaaactgattttggtgtatttgacttaaagcaaacataatgtattccctaaaactgagtatatatccatcagaacaaaaccaagatatttcttgagcaatcagtcaacagtgttggctataatatgcatgtaagatataagactctgcagccttgtaaagctgcggtgaaactgagtttccaacaggtcagagagtgacgaaattgcagtagctctactccagggactccacagcactctttaggttgggaaaagcaagtgagttgcttttacaggtgtaaatcagagggatggaaattattgatgagataatcgagatgggatatgagcaggtattcagaatatatacggtttgcaaatgagaatgaagacttcccaatccttggagcagttcataaaggtatgtcaaagcctgcaggagcctaaggaagaatgtgctaacttttgaaccatgtagatggctcataagaaatataaatattgaatacacttttgctgctattagtggctgccttcatagttgtgctcagtaatttgcctgaagaccctcaagccttgcggtgttaaacattgtgattcaaaacccaaatctagccaaggccgtccatgtgttagatgcttctccaccccaggagacagggcctggagttggtctgtgtgcttggagctcatgaggcaatgacctgagctgcaaatcttcagctgtgcacccacaaagctgccccagaatcctagccatagtgtttcaggccagacctcaacttttcctcggatcatgggttatactccagattttgaactggacagctggacaacctttaggaaccctcccctagaactgggaaaactcctaaaccaagctcctgcctgacccactctccaggctccacctttcccctcttctttatttgtttatgatggagtcttgctctgtcgcccaggcttgagtgcagtggtgcgatctcagctctctgcaacctccgcctcccaggttcaaccaattcttctgcctcagcctcctgagtagctgggactaaaggcgcacaccaccacgcctggctaattttttgtattttagtagagatggggtttcatcatattggccaggctggtcttgaactactgacctcatgatccgcccgccttggcctcccaaagtgctgggattacaggcgtgagccacagtgcccagcctccccacttctttattaatgaagacagatgtcccagctcaagaaaagagagtggaaaaactcctccttcttctgcctttctgttctatccgggctctgaaagaactggacgacgccagcccacgtggctgaagacaatcttctttactcagttcactgattcaaatgttaatctcttctgaaaacactttcacagacacacccagaaataatgtttaaccagttatctgggcatctcttaacccagtcaagttgacacataaaattaacccatcacaatgtcattgatgaaaattgcctaaatacctccacccttgtgaaattgataactaccttgtctaaccacttagttaatgataagtggaaatgttgcctctacatcatgcaaaatgtgacagatagggaataaatgcttagagatgcttggatgaaataaagccttgtccagatgaagaggtttttgttttgggcatttgaccttgggaagcagttcaattaaaaaaagaaaaaaaaagtccccgtcagtgattttatagcacctggtaaaattgcaagtgattgctcacttctcccctgctccttcacccctgcaataagctttgttgtcggtcacagccttatgacctcctctgtgctgctcatctcacagagagtgtggagcaccctggaagtgagactcaaggccaccagccttctgcaatctccaggtctgtacctggagcaaactctactctgtctctctctctctccaagtttccttgcagaaggcactgctgacagaataggtgagacaaaatatagtgaaaagaggagctggtgccatccaatccagagagacaactacctggcctgcagtgccctgggcttgctggcatagctgggctcaactgaacctttcctgcacaacatctctattttgtgacctcactgtggcacactcacctctcaaagcgcttctgagacctcccctaatgtgaactaccttggcatgtttttttccacccctgcatattattgtttgtgtgtcactgttctcattgccagggcattgcattgggatttctttgtcagagcacataaagaggcgtatccagaataggtatccagccagcataaaacaatgtggcataatgtgttgctaaagtatatatattttaaattcttctgtagtagttggtaatcagaaatagtttacttgagaccacgcattatctaatgacgttggcccatggaggctgtggtggtggtgtggtcttgggagtggggctgtcttggaggtggacagaggtggaggttccaggtgggatgtgtgcaatgcctcctgctgctctggagtgggccagaggtggcagggacaacccaacagggtgggggctgaggctaaccttgaggaattggggttgggaccaagacaatggtcttttaagttcaagctagctgaaaagtgctggcttctgggtgatgcccagcccagacaccttcttttgtaaccagatgtagtgcactggcctgatgactattagcttaatgggaggtcaataaagtgtgtgaggctaaatcacagtgatgcagaatttttctcagccactttgccaacaagagacctccatggctggcgatatccccctgcctgggccttgctcagccccgggcctgccattggaggcacccccacccgctgagcttgctgtcctatagcttgtacccatgtttggcagttcccgagctcctgtcccgtgtccaagaagaatgaggatacactgacaattccaagggtgaggatgggcagagaagaattgtattgagtgatggaacagctatcagtggagaggggatacagtgggtggtcccccaacccctcagttgggttgtttatctcccagtgtggctaggtctggagctttttatggactcaaaatggagagtgtgtgctgattggtttatgagtgtgcaaaaaaggttaaaatgaagacaccactcaaaggcacgacagtgtagaaaactaattaggaaaggataggtatatgtaaaatagatgaagggtggggatcaatcagagaaaagtgcaccaaaatggaaagacaggttctcaatccagtctgtggatgtacccaggacttatagctaggctttaaactgtcttcggcttgaaggttgggtttcaatggggacccaccactgtctgcctagggatttgtctgtctcctgccactatcaacagctcagccacggacgtcagcttgggacatctgcccaaacgagagatcaccctagcaattcctaaaatcagaagtgtcaggacagttgggtaaacaatgctatagcttcagaaacttgctgagcagtgtgtgagtgtgtgtgtgtgtgtgtgtgtgtgtgtgtgtacagggatatgtatgaaattagaggaaagtttttaattactaatttatgtatttgtgcaggttgttgaattattttagtatcaccccagatatacatgcagcacagcagttattgaatcttttcagttactgagtcttttattttacttttccaaattttgcaagtatgtgaactacaactgctttctttctctatttatttgttttcttgctactcggtgcatgtgctgttgcatgcaccaagttaattcattttatttccctaacaaatgtcagtatctctccctccccctatgcagcacatcattgcccactcagcgtcactgtttggcacattcaatgtggaagacacatgggtgaatcattcccagcatctggacatttagagtcagctggatgctgttgggtgtcttatttttcatgcagatgtgaggcattatataaagcagccacatttgtattaatgttgaaaggtcctagggtttctgcattatgaaatgaaaaatagctattagctactattatctgatgaggtttgaaggtatgtagttctagaaggaatattttgaatggacataatttctcaaataatatatagtttttatcctaactacaccaaagattttgtcttataactgtgctagcactattaaatttttgtcctatcactagaaattttgctattttagacaagagaacctgactttggactatgatttatgtaatggaatttcgagtggtccattaaacttatttaataaccataaaaactggcataaaattagccataattcatcaaatcttacattatattcttagtctgggattgatgtttaatcagattttttattgtttcataacatttaatgggctatttataattattttctcaactatatctgatggaaaaatatattacagaagagtttttaatgttccagaaataaggatataaatatacaaacagtgctcacccacacaggaactaaggcaaagattgttgctgttataatttcagagcaaatcgattggcctttgtaagctatgattagtgtagacatcctaataacagcgtgtggtgaatgctggtcttctgaactttaacaactcctccaattcggccaccaataaagtgatgataataggactgaaaaacttgttctcacagtgataaatttgcatagccccatgcatatttgtggcttgaatttttcctccttcaaaatcccagagcaaaatttgaacaactttgtgtctttatgatgttataaattcttggcaagaaagtatagagtgatggcagagagcaaagcgaaactttagaagagaatattggcagaaacccttggagactggtcccgagctgtgtgtgcaagtggatgcattcatgcatgcagggcatggaggctctcagctgtgatgggacccaagagatggtccagggcccctggagggcctggaagagattggaaacaagagtcgagagtgttccctggcagctgagcaaggccagtcagcctcactgaaattcaactgcacaccagctttctacttaatatgttaattttgtgttccattttctcctgcaatcctttctgccagccactcttcgcttttacatgcttcatgttggaagtcattatttctgtcatctctaaatatttcatccaaggaagaaaagctaggatatgtctagagaacagaaactaagtttgtaggaagtttggtgggcaacacgatggactccagatcagtcaatgccacgtgagttctctttgctaacaagaaatcagtgctcatggtatcaggtgaacagccccccttttttttttttttttttgacagagtctctcactctgttgcccaggctggagtgcaatggcaagctctcagctcactgcaacctccacctcctggggtcaagcctcctgcctcagcctcccaagtagttgagactacaggtgcatgccaccacacccagctaatttttgtatttttagtaaagacagggtttcaccatgttggccaggatggtctcgatctcttgatctcatgatccacctgccttggcctcccaaagtgctaggattgcagccaggagccacttcttttagtgattttcaggattaatttctaggccttatgttccaccctgtgtctttcttttcaatcctagtttcacagcctgctcccttcatcggctcaaacttcatggtggtactttatctcctccaccgcctccaagaacggtatcttttcatttagtgcagttaattttataggctaaaggctctaaggttctaatacttgtattgtttttcactctgcacccattgtattttatagaggaaatatttttgatgtcccaagacagtttaaataatttattgttttggaatattccctggacacaacaaaatactttttgctcaatttttccatttttctaaattgaaatgaatttagaagtgaatatggtaaaataattgtataataaccacttgattttttagacccatgacctaatatcatcaaaacacatcacagtgttttgtgaattacaggagtatttacctcagatagagaattggattgtgcatttctaacataaaacatgaagaggggcaccgtgtatgcctgcctgattgctatgagatttaggaatcgtcctacctattcttctcatactacttatagttataagtctttactaaatagtggatgcctactaaaaaaaaaactgaattaaagcatcacatgattccacaaatatggatcagttccaattttcactattttaccctaattcaattaacagccttctacagtccagctgaatttcatctttatgtatcatcatctctaataaaacatttttactcttggttcatgatttatactgctctttatcggatactttacattcagttattgcatctctgtggtttcggatgcctgtgtagcatactcaatcatcaaaactgtaagaaacagggctgattgttatttctatgctcaagaacattttctttaattgctgtggctttcaggacatcaaacaaccaccacagaaggaagggaaaggaaatattagggagaaaggatgcaagaagagagtacgttaattattctcaaaagagcccatcatgctctttctaggctgtgctaggaaagtgtcctagattggcagcccccggtatgtgtatgcttctgtggccaaaacctgaagctggaataaaatgaagtgtttttttcttgaatctttacttgcaaaatttggtagaagggtatgagtgcttggctttagtaacttgaaaacaatttttaaaatttggcagttgtattttgaaactgttttaaaaagaagaatgactatatatctcctcagattttagggatggaacgttttgactgtgagttgtccaggttcttggtgcattgagcaaagaactaaacaaaatccacaaaaaatgcaacaaggaatgaagcaatgaacgaagtaacaaaagtccagctttactgaagtgaaagtacactctacagagtgggagcaggctcaagcaagcagctcaagagccccgaatgcaatgttctttagggtttctattaagctaaaagaatttggtaacacccctaggtgccctttcgaggcctccagttagtcacaccctatgaaagattggcccaccaccaatcagaggctgaagtgaagacttggcccacagtggaccagaggctgaggtggaaactactgttttgccatcacaggagtgagggcatggcctgtgtgctaatctttcctagaactggccgaacctgctgttttcttgcttatgccttaacccttggttaccctaaaccctattctcctgcctcaccattggttagctatccattttctattttcactcactctgatgagggtcccaactacagataaaccacttgactcaccaaacactgcttgctgaagtgagaaatgtcataaagttatctgagtttggctttgtactcttttatttgaaagagcgtgttcatccattaacccatccattcagaaagcatttattaagcacctgctgtgtgctggctttgctcactctgccaagctgtgaaatctgtttctctaggcggagttctgaagtcacccacattctgaatctcagtcttggaccaactgaattagaatgtctgggctggggcttgggaagttgggagtttaacaagatctgccatggtttttatgcatggtgagcctgctggtctcaattgaacaaatgtggatggaatgaagcatggattagtctgttcaggctgccgtaacaaaatccacagactgggtaacaaaaacaacataaatgtattttcacacattctggaggctggaagtccaagactaagtgttggcaagtttggcctctccttggcttgcaggtagctgcatactcattgtgtgctcacatggtgtttcctctgtgcacacatccctggtatctctgtgtgtggccaaccttcttatgaggacaccagtcattggattagggctcactttaacagcctcattctaacttgaagactctgtctacaaatctgattctactgggactgagggcttcaatatatgaattttgttggtgagacaccattcagccaacagcaaagcaaaagagtccactcttggccggcatcccaaattagttgaacctctgccatctcaagccagagctttgcagtccactctgaaattggtgggtgacctgtggaggtagtttctcccctgagagcttctcagtgcacagttaaggctctgaagtcctcctgagcagctcgcgaaactgaatttaaaccaaagttttctacaataatttcaccatgaccctctgatgtttgcaaaatttctgttctcaaacaggttgctcacttgtaaaatatgttgtttctccaagctagagaaaataaaacaagaagaagtcaggccccttcctgaaggccacccaaatgtgacttagagatgagatatcaatctgtcttactcagttcaagacagtaggaaaaacattgtgtatttacaggcagtagccatcagacagatcttattcctacatatctgagctgcactctggaattttatcatattaatctctagtgtctcttcatctacccaccccgccactcatccctctaatagaaaacagttttagttcactccagagactgcagcaggtgccaggagcctgaaacacacagcagccccagcctatgtatcccagagccctgagtccaggctctatgctcttatcaaagcaaatacagagcccatcactgggtctcctgggaggccctctgccctggtgattctcattctcatcacacatcagaatcacaggaggctgtaatctttgagaggccaaggtgagccaattgcttgaactcaggagttcaagaccagcctgggcaacatggcagaacccccaactctactaaaaaaataaaataaaaattagctgggcatggtggcaagcacctgtggtcccagctactttgggtggctagggtgggaggatggcttgagcctgggaggtgaaggttgcagtgagttgaaatcacaccactgcactcaagcctggatgaaagagcaagaccttgtctcaaaatcatttttaaaaaaatgaaaatagaattacaggagagcttgtgaagaggcagatccctggacttcattcctcacctctggaaccaaaaactcctgtaactgggggcagaaaaatttctctttttggaagctctccaggtgattctagttctaaaccatggctctttccggtgtaatttctcagtactcctaatgggtgcttttaactatgacctagatcagctgctccctcttgcttgtgctggatacatacttatcgtgcctctgttccagccatgtcaccctgctgtgctctccgcctccagtgtttcttcattctttagactagcacctgcccctcttcaccagggaagcctgcatcatgaggaacaccagtattgaagtcttcatctctgtgttccttcagggctgtggagtccaacagccagggcccagctgtgccagtacaagatgtatcaccctggacaaatatttaccctctctgagccttgattttcccatcccaatccacaacaggaatacatgaatataatctttgtttttttttttttttttgagacagagtctctgtcacccaggcagagtgcaatggcgcaatctcagctcactggaacctctgcctcccgggttcaaacaattctcctgcctcggtctaccgagtagctgggattacaggcactggccaccatgcccagctaatttttgtatttttagtagagacggggtttcaccatgttggccagggtggtctcgaactcctgacctcgtgatccacccgcctcggcctccccgtagtgctgggattacaggcatgatgagtgtaaactttgaaatacatattaacttggcttttatcagtgtgtagtaaggctctccatgtcagagtaaataaatccaccaaataggagtcaaataaattcttatctgaaaatccaagccttaagattaggatattctagaacttctcttctagatattttcaatcatgttgaatctcttgtgttacatatttaagagaaggagaaaagaaagcttcttttgaaagcctgtgaccaaaagaaagaactggaaccagcaaaagcaaattggtttgttttcactcaaataaccgtctgcttgacttaaatgtgatctggcaaatgggcattgctacaggaaacaaaaggcttcttttgagcttctagagaaagagaaagcatcctgaatacttaatcaagataccttttcctacaattagtggaaaccagctcatgtctgttttctctcgccccgtttccttgtataacactcatctagctgcttccgtgaggtagatttaaacgtccaccacccagaccacacccatggggccaccaacattctagagcagcttgctctgtgcatcttatccacactgccatgcgctctgtttatctcattagaaaaacccttgcatatttactaaaggcaagaggcaaaataaacgctgagttacatatgtaaaattccatgcagcatcgttctcctatgtattactaggtttggttattttacatgaagacagtttctttttacacaaacagtagggctcttatgcagttgttctctttcaacatgaacacaatagactagataatgttgtctgtttatatttctttccgaaagtaggaataatttcctaaattgctttcacgtactgtgtaaaacaccgtagaagttctgaggcttatctgacatctcattgtcccctggtgtgtgtgtgcgtgtggtgtttttgtgtgtgtggggtgtgagtgtggcagagaggaaaggggagctgtttgattctgtagttccttttctgccttcttcctttctctgtaaactttggatacttatccaaattactaacggcagattgagccctatgcagatggcatgtgtctgtgacaacctctgctctccacatctcttgggcctgtttacctgcgctcccagagcctccgccagcatcccagaatctccatccccatctctcacttatacacacatcagtcatcggttatccattagctaaaccgccttccttaatagctttacactgtttgctttctctggaacatttttagttaaaatttcataatgcagttgcacacaaatgaagacacagatggctgcatcctccgtctcttcccctcgtttacaggaagctgcggatcagggaggggtgttagggttacccacatggtaagggcagagacaagaggggaccccagttttccatgctgcacatggtcattgctggggactgaggtttgcacatcaccctgccctgttctccctccgctggggagaaagtcagggatggagcaagctgcagcatcttctgaaaaagaaaaggtggccttgtctccaggtctcccctcaagtcccaccttcccatagttttctgccacttctcttgattttcctctctgccacttctcttgattttcctctctgcagctgctttgaggtgggttttctccagatgcacactttcccctgctttgcgtccttattctggtagaagcacaatctaaagctcattaagggaactaatcaattctgtgcatggcgctagctcagcagatcaccacacaggcagcactattagcaagtcggtgcttaacacatggcacttccatgaatcgatatggagcccgtgtagaacaaggcatgggtttttttctcctcccattaagaaaaactgatgccaaaaataacttctcagatattttcaagtatgacttttatggagggaaaaagcatttttgtttgcaaaatcatgcttcaatgcaggccagttgtgaattgtgatggcttttatttctcctggggctgtaactttaagggtttagaatttggaaccacagcctagctaatcatgacacacacacacacacacacatgcacacacatacacatacacaaagcatcacgaagaaccatacaaattgtacattattttacacatggaggctcactctaaaatagataccattttaaatattaactaaaacttgtgctcattgtatgttcattctatatgtactgatttgttattcacatttctttcaaaatcgttcaaatttctagcccacatcaattaaatattaatagtactttctacaaacatgagcgcacaaaataaattcaaatctatttttcccactggtgttatcagtactgctcatactttgtcagtatctaagtatcacatgatcttaaaactaatgtcacatactaaaaagcttctgaggcaaattgtagaaagaactctcaacatcattgttctactggacaacatacataaaattattttacagtgatgggagagaaataggctcctcatcctaaaagctgcgaagacagtagcggtgccgtgttttggcgttactcccctgtggatcccagcgacgggtggatttctcctgtgctttatcatcagacacaaaatggaccaaaatggaccaaaatggacgagtgtgagggacacagaggctgctgtaaaaaaaaaaaaaatgcaggatatttatgggtctatgacgacccaaataatgagcaaacatgggaatcccctgctgaaaagctgtcacagaactgaagcctgcctggaaatatcttgagaatgttgatatcattttaataggatctaaaatgagaattctatcaatataaaacagggagaagggcctccttctatttttaaaaatacccaacattcatgtttttcatattttcctagcctataattactcttaatcaaagcacaacaaatagtaaacagtaaaaatgaaataaatgtggtgacagtttgccaataacgaggagaaaatgtcccatctgtctagccgcgagtaaaatgggtgtaattaccgctcatttttctcgtaattgctgagttattagtttaaagcttacacacaactggtgaacagtgagtactacccattccgtaattacagccccagcctcgccgtgcttgaaatcagggaatgcaagagcagaggaaacgatctgaattaaccctgactgcttgcacagaattgtgactgtctatcttatatttaaattttataaactctgagttcctttgctatccaaatgttaaactggaatgtttgcaaatccagcttgaattctaatttgcttttaagctatagtcttgcatctgcttctaatggtgaatgcataaattcatttttgatagaaataatccatgcagaccaccaccctttgcattgcatttgttaaagttatgcatggttcactgatatgcaggggtctgttagcagttatgttaccatctcgttaccagggaaattccatttgaaagtttaggattacacatgggtagtcaacacctgacgtacacagcagggcaaatacagaaaaaagaatctcccttgattgtttctgtttattacaaatcaaagattaagacaaatagagctgtggtttatttcttcttccagtatgttattttatctctgagattcacctaagaaagactaagttctatgatgttctcatagaactatagctacttttgcctaaaatgctgatatcattttaataggatctaaaatgagaattctatcaatataaaatgggggccgggcatggtggctcatgcctgtaatcccagcactttgggaggtcgaggtgggtggatcacctgaggtcaggagttcaagacctgcctgaccaatatggtgaaaccccatctctacggggttttttgtaaaactacaaaaattagccaggcgtggtggtgcgcacctgtagtcccagctacttgagaggctgagacaggagaattgcttgaacctgggagacaaaggttgcagtgagccaacatcatgccattgcactccagcctggctgacagagtgagactctgtctccaaaacagaaaaagaaaaaaatttatatatatatatatagatatatatttatatatatttatatatgtatatatttatatatatttatatatatatttatatatgtatatatttatatatatttatatatgtatatatttatatatatgtatatatgtatatatttatatatatttatatatttatatatatttatatatttttatatatttatatatatttatatatatttgtatatatttatatatatatttatatttatatatttatatatatatttatatttatatatatttatatatatatttatatttatatatatttatatatatatttatatttatatatatttttatatatatttatatttatatatatttatatatatatttatatttatatatatttatatatatatatttatatttatatatatttatatatatatttatatttatatatatatatttatatttatatatatttatatatatatttatatttatatatatttatatatatatttatatttatatatatttatatatatatttatatatttatatatatatatatatatatgaatgagaagggcctccttctatttttgaaaaatacccaacctttatgtttttcatattttcacattctagcaaaggtagattttctgggttacctctctttggggtcctgtctttggtctatacagggaactgtaactcaccacagacagagatagtgctgagatgacaaagctgggcttgattccgcttggatccctggcttctcagccattcctgatgaaccttttattagctgcctgtctctgatccgggaacactgatgacaggtgcgtttattttgagggagcatatcctcaagctatggagtggttgttgaatgagatgttgtgaaaaaaaaaaaaaaaaagtcatgagacccccggccaaaatcctcagactagcgtggcattttttttttcctagcaagttatgtcatttaatttatagatatagaagtggagacaatgaaaatatagcatagtatgttcatttccttcctctgagcctgagtgatgccaaggcatatttttctatgttagagggactaccctggaaaaaggaatggttatagtaaaatttggtatggaagattcactgatacgaatctcacattttcggaaagagaggagatgaggaaaggacttggtgatgatcaaatataacctaagaatcaaagttatttccattcctggctgcagaagcagtgaaccacccccttccttcttccctctctttctttctctctctctccctctctctctaatatttaacctcttggttgagataagctggtgaaaatcatggaaatgtatttttaaaatcttcattctaagcccccgagaaccacagtatgccagattcctttgagctccgcataaatgtcttggctccgtgaaccacgtgcatcttatgcataatcctttggttgtgcgcgccagctgggcagcagagatagcgagtgctggggtcttgcagctttaaaactgtgcccaggcctcactcagaagtaggaaaatgaaatgagcatttgcataatctatctcgagttacccaggtttctttcaatcttcttatcacgtttttaaaaaaatctattaagagaatattagaacaaaatgcatttttctcttcagagaattcattttgcctgcgtgtttgggtcctatagggcttttcatttgttttagttttttaaaatgccttaagaaaaatttttaggagtttactttgttcctactcttctctatttgagtcagcaacacatatttagattaattcttttgacttggaagtgcagttctgagcgattacaaaatttttatctaaaaaggctctaaatgaattgaagttgtgaaaattgtgataatttatttcctggaattgaaatacagagagaaactaaaatacacaccacattttaattcagtgttaatttctcccatttgcttataaaagaaaacatggtgcagatcttgtgtacttgaaataactgtccacacattctcaatccacagtcacgaatcagacacacacacatgcacacacatgcacacacacctgcccacgcacacaccggcatacactgctaaagtaacaagcttgctctccaggcctgtgctgccaaggctggctggccagactgcctgcctccctctctctttctttcttaactagattattttcattaactctactttctaaatctttctttacctcggtagcaatttgcagctgcatcatttactgacacgtgtttcttgaagttccctagcaggcactgagttttgaaatccagcggtctccagtgtctggcccgcacaccagcatttggtactgctgccctgtccttttccctcctgctgacatccctccctccaggctgtctgctgtgtgtcttcgctttctcttctttattttcccctttctctcctgtcgatgggatttcccttctttcttctgccttgtctgtcccctctctgtgtcccttcttccttgaatggtgacctacctctctacaggctgttcccagatgccgtcattctttcatttaacacagaagtactaagaactcatctgtacctggtgctattccaggggctggaagactacagaaaattttagagagacaaaattcctatctttgtgaaacttatattccagtgggagcaggcagacaactactaaaataaacatgtaacatgctatgtttgatgaaaagtgttgtagagaaaaataactcaaggaagggtgatagtaggttgaggctgtttaatgctttaaacaggatggttggtgaaggtttctgagaggtggacgtgggtgcaaagacaccctttcttctcgctcagttattaccaaaacggaaaaatcaccacgtgcctgtgctgaagacaaccttgtagatacacaggcttcaaatgaatacactgaagttcacacatttctttaacctgggatgtcccaaatatttctttttagatttgtacatattttgttttactgatagcttatttgatgtattaagatactattacagagaacaggaatttctagggcatattgggaatgaaaagtatggccatcgtgttgcatctgagctgtgggtccccatagaaatgtgaagagatgagggaaaaggataaatctttggaggaagagtgttgtaggcaaacagaaccgtaagtgcacaagtgggagtgtagtaccactgcatgctggtagaagccttggtagtgaagagctgagtggggaaacacggttccgtcacaaagtccctctgtgtgcagacagaggctgatgccagctctatgcctactgccaaccgctgccaccaaaaattacggacagaacaagaggaacaaaagccacagagctggtctgaatctcattcctgaaacatctttcctcttattgttttcaaactttctgtgttttgaaagttcttaaatgtaactcttgtgcttttactcctccattaaccgttcatcaagtcgtctttcaataaagagacttatatgttgtgtctttgagattcctttatattgggatataaaggagcatatcccactaaggaataaatagctgctaggctttctctttctttctatttgttaggctatgttcctgggtcgagaataagaaatagtaaaccctttgtgtcctccctttgggagaagaccaccttatacagcaacaacatgggatctctggggcgcatcattccctgggaggcttcccaatctaataggagactgcctccctttgggaaaagacaaccttgtgttttctgtgtatggttcattccaagttacacacatccaagcatcttacaccattgaacacgctctcaaaattcactccaggcatttgcgttttgactccatgcatccccatcaaacagttcttagcctacagtcctgacggaggcccatctgagcagccatcttattctcaatgtctagctaacccctcctttcttctcactcagttattgccaaaatagaaaaatcgccatgtgcacgtactgtacgtggctgtggatacacaggcttcaaatgaatacattgaagttaacacattctttaatgtgggatgtcccaaatatttctttttaaatttgtacatattttgttttactaatagtttatttgatttattaagatgctatttactgagaacagcaatttctaggacatattgggaacgaagagtatagccatcttgttttatctgagctgtgggtccctgctcttgcagagagatgtggaactgggtcttgctgtgagatcttgtgaagtcaccgccttcctctcaggaccaccgccatttgattatacgttgtgtgcattccttcacgtgaccatgtgccagatgcaatagaaaaagtcgtttcagactgccactctctgcttccaaaacccaagtatcacattggttggaatcgatgaaagtaactgtcacccagcatttgtgttcgctggtgatgatgtattaaatagggaagaaccacaggctgggaggacatcagtaaacaacctaaagggggttttaaatagcaaatcaatatggaacaacggatgtagaaaattaccaggaaatggataattaagttcctgccatgctcttttacaaaatctctgagaataaattctcttaggacaaataaagaggaaaagtgatgcccatgaaaaccttaaggaaatgattgagtgttggtgcttaaagtgatggagtatcggtggtgtcatagtgtgcaaagggaacccacagcctcttgaagggattcgcacatggtcacgtccatctttccattccagtggcgctgggcttcctgtggatgcagcacagttaagtgtagtggtctttctaaaagcaccgcacaggtgcttgtcaatcaacgtggaatgaaagccaccggcctagggatgaagagtgagtgagacctcttgcattttccgactaagcaatttcagtgctgtcgtgtgatcttgttattccaataagcaaaacacgttattttattttgggctcagtgttggatatactgaaaacaatgataataaccagcatttactatggagcacatactgtgtcccaggaactgtcgtgtcctttatatgttttacctcgttactgagtgtgtgtgtaaaacagctctttattatgtgagcagaacaactccccaatatatgtgtgatagtagtgtgtcttttaatacatttgtgtatgcatatgtatatataaaacaactgtcctctcaccctccccccacccaatttccttttattcttgtaaacgactttctctacctcttcatttttttatttacagaatgacaagtattcataaagccaggtataggcagattctatcagttggctacaatagctggatttgtcttgggggtagttttatttattattttgccctcctatttctgacaggctcatgaacccctgagcactggggtcagcatagacctggtcagcagccttggaagccagcatagctctttggaggccccatgcccagggcactacccttgcaaactcagagctgtaaaaggatgccctcttcaactgcgtggacgcgtgctgttcaaatgcaccttctcacagaacctgtgcagtagcgcagggaggcagactttgtcagaattgtacccacattttactaggaaagcaccaacatgcagacagtctgaagaacttgcccatggtggcgaggatagtgtcaaagccatggcctctgttgccatcaccctttatttttccttctgcaccacaagcccatgtctcctgatatgactgggaagcctcatggggagtgaggttccccacagagatcagatgtgttgctgtataacttcctactttgggacagagataaaatggatgacttctttggccctcccagtcctgagattctatcatccagattcattccagtaaacatggaacaccacctaaatgtgctggagtgaacagagtgattgtttccatgactgatttcagtgtcttaattccttctcaccaattccatgactgtggggcctgagggacaggacaaaagagtagacccaatactgggaagtcttattgggttgcaggggtgctctgagtcagctggaggaaaacggtgaatcacccatgcaagcccagaatcccacccaaaaccatgcccagaattcagacacattttattttaaagaaataacaaaagtggttgaatgaggcaagatgtgggagtgaaagactggacctgatggtgacagctagggaaaggaatctgagctgctagagcagttcagtagctggctcaattatcaagcggtgagatttgctggcaagagtcaaataaggaacaagaagacaaatgacatggggcagatagagctgcactgtggcagagctgatctgcaggctggtggagcagaggaggggagccactgagccatgcagagaggccacgtataagataatacgaagtgacttggccaaaatgtgtaagcacagaaggttcattgctggcatacacaatttctgctacataacatggtgtccttaatggccataactgctgaaaagcacagggagaaagtggatgttatctaatttataaaatgataatacttttattatccagattgatgacagatgctccaacccccagagtctttctctccttggccccttgacctgaattcttcaagcggggacttcgtttcatagcctctgagcccattctttcttcccccaactccctcaaaaatcaaattacattgtaatgatctgtccacctttgggtgacactctaccgtgttcatctgagactctctccagcgtttttgtttgtgtccaggcttccaggaaagctgatggggtctacatgcacttttcctatatcccccactgacaagtacagtgaaggccgaatgctcagtgaacagtaactctctgccctaaatccaggtgggtgatggatcaacactgaacttttatttatttatttttttagaatatattactttggctgggcgcagtggctcacgcctgtaatcccagcacactgggaggccgaggagggagaatcacttgaggtcaggagttcaagaccagcctggccaacatggtgaaaccctgtctttactaaaaatacaaaaactagctgggcatggtcacgtgcacctgtaatcccagctactcagaaggctgaggcacgagaatctcttgaaccctggagacagagatttttgttgtggtaaaatatacataacataaaatccacaatttgagccatttttaagtgttgactatacaccatttaaagcaacaaaaatgtttgcaaattcgggttttatccaacaatgcatgcatttcctgtagattttattctcacctcacctctgtatgaactctctgcctctgcttctgtcaaatgtgtccgttccctaatattagacatactttgtgctttcctgcttaattaattgtttatacagcccttctctttccttttcacttctgctttcctggccaccacacctcttcctgttgggctccatggtagacatccatcagcatttactccttgcctcccagggaatctaggtcataaagggcaccctctttgtttatagcacttaatagtaattgtaacatctctatgttgtctatattgtcatttacctcttctattaactattcacatgctaccagataacttcttttattaatctgtatgtatatgtcaggttctatagtagatgccaggtctccaatagtaaatatgaatatgattattaatattaaatatgatttgtctccttttctcatggaagttttatactctggacaaagggcagacattgaacaatcactgtatcaatcagaataggctatgttgtggtaggctaacaaccttcagcaccttcgaacaacaaaggctgattaatttcttgcttactccatttgccctggtggctcagctgtgactttcatggtccttactcatggaccttccacactgagggagcatgctgcatctggggaattttggatatcaggagcactgagaaaaagagaacacagtaagtctcaaactagctcttaaaactccttcctcacttctcctcttgtttcattggcaaaaacaagtgacacggccagttctggcttcaatggttgatagatatgtaatcttcccctgaggagtttgggtatcgtttaactggatatacaggctatacatacaaatgcacaattgcacatttttatgagactcaaaacccttccaaagtaaatttgattacttctgtttgaatttggttttgaattttctagaattaaagggttcgaagaaatgtataaggataatcttgtccaatcccaaatggtttgacccatgactctcaatctctgggcctctgcataagagtagagactaaattattttataggacaagaagtagagtaaacatcctaagtgcttgccatagagtaagtaatatcacacacacacacacacacacacacacacacacacacacacaccacacacacacatactacacacacatacacacacaaaaagatagatatatagggctgggtgcagtggccagggaggccgaggccggcagattgcttgaggccaggagtttgataccaacctgggcaacatgtcaaaccccatctctccaaaaaaattacaaaaattagctacatggtggtgcatgcctgtagttgcagctactcagtaggctgagttgagaggataacttgaccccaggaggcggaggttgcagtgagctgagatcgcaccactgcactctagcctgggtgacagatcaagaccctgtctcaaaaaacacaagaaaagatagatagatagatagatagatagatagatagatagatagatagatagatagatagcaagtgcttataccatggaccattctaaatgtttttcatctattaactcaagagtcaacaaactttttctgtagagtaacagacactagatattttaggttttgtgggccatgagatctaggttattactacataactctgccactgcagtgcaaaagtggccacagacaatacataaacaaatgatcttggctgtgttccaatacggatttatttacaaaaacaaacagtgagctggtttgacctctgttttaacttagtttattctgatgacaaccctactgttatccccattttatagaagaagaggcctgtagaggtacagtaatttgtagaagtgcagttgaggcttgtagaggttcaatcatttgtcaaagttctctcatctggtaagtgggggagccaggctttcacaaaggcaagttggctccagggttcatgatcccaactgttaggattcatttcttctctaataatgctactctgctgaattcagttaagctatcgaagtatggatcagaaaagagggttgggcttccaatatatttgctcattttatggatgatcttttctgtctacaaagacaaaagacacaaattatttgtggtttcattgtgctggggttgtgtgatttactgagccacactaaatacacaacaaggtggtatacaaagtggtcaaatgtaccatctgaatcattcttgacatacacggacacacaactttgggggtcttcaagtttccttctacccttcccagcagggtagaagagaagacaaaaacacagcagaaaaactctgtccaagaatgggaaagagtagttatggcatgcttaggtggtgggaaacagctgatttaaagttagtaaatctgaatccaaataatggttcgatttctctgtgcaaccatgcttaaatccccgtgcttctccaaatcggagctttcacgtctgaatcatggagatagtatatctactaacagatgtgctgtgaatgataaaggagtttaagtaagtgcaagtgttggctaaattacagcatcttatagatatatgtaaagtcatcgctattactggattgtccttagaaataagggttttgcttttgttgtatttcaaggtgacttaagtatggttgactgcatatagaaaaggaagaatccaaacatgtactcgctgtaattgagtctttaaattgcatatttaaagaaaattactagcttttaaaatcccaagtgattttagagaagactcacagaattgttaaggctttccacaacatatttactcatatagtgggggtggaaggagttggatttgcccttgtggttttcatagagttgacagcttttcttgcctattccacaagttctaatgctacataatttttaagatttggtccactcagctatcactgtgatctcccaacttaaatctgttatcaatttttcagtcctctcctagttctttgcattcacttctatttgccacaggttattagagttatttgtccattcattcaactaacgtgtggctgtctattatggagaggcagtgtactagatgttagggacacaaagctcatgaagtagatatggcttctgtcctcagtcggtgtatctctcagtcagaatctgttacttgagggggcagctggagctctttctcccttcctagtaggctgagcatatggaaaccagattcccagttaattttagttgttgttttcttgatacgtaaagaaaagatccataaactcaagatgctttcttatgaatcaagttttcaagttttatagcattcgctttgtactacttgttttgaccccattgagaagttttatttcttctgttctcctgattcttcgccattttagcagcaaatatgtacttaccatccactatgtgattgatgctttggaaatacaatggaaaacttggtagcaatgaaccctctgcctttaagaagcttatattctattttagattagggaagcaggaaggtctctctatgtacaatagaatgggaaagaacgagccacataagtggtgtcaaagaggaatgcaaaaagacagcatggctggagccaagtgaaactaaaaagaagatgaggttgactagagacatgattcagatcaccagaggctgggaggcaatggagagcattttgatttgattctaagttcaatggaaagtcaccaaagagttctaagaaggagtataacatagggtttgacacagtgggtgggtgaagaagatcacacttgctactagagatggggagtacgttgtagaggggaaagtatgggtgcagagagatcagatgggggttatttcaggtgtctacataagggatgatggtgacctcaaatggaagtagaggtaagtggagagatgtgagatacattttcagatagcaggagtaggacctgctgatgggtgtgttgacatgggctgagggcagggatgaggcaggaagatggtaaaatcaagaatattcctgggttgcgcaacactcctctgtccactccctgtgatgcgatttggcatttcccaactctgccttccctcctaaaaatcaggaatcggtcttatattaattttattttgggttctgtatctgttgaattccataaacatctctcatttttttctggttactcattcatctatcagaaattgtgtaaagtccatattttttcaaatttagacacctaaataataaagatttaaactattaataaacatgtacttaatttcaaaaagagcctgctagacataggtgaatagggtttcccatttcccgagaggaggaagaggtgaggaagattgtgtggggaaaattgagaggaaaatggagcagtagtaaaggagaatgccagctaaagggaattttgttttgttgttgttatttgtttatgtgttttttgtaaagatgagatacagtagagcatgtttgcccagtgagtacagtgatccaatagagaataagctgtcgtggtgcagatacaagaaagataaaagaacagacgtaatgacatccttgagaaggccacagggtgggggctttccagctcctgcagcaggatccgccttgagtgggtgattggggtgggtgcagggtagagagagattctaactgagcaagtttaggatgagggcttgcactccagaaaaggctggagaaggcactgagagagctgttaggagggaagccagagatgagaaacatagaatctcatctcagggagtgaaaaaggagactcctagacacaggatggtgggcctttgttgagcgactcttccatagaggaaagtgccggatagctggtttctggagaatttaagtattactgtattatacattataatgcatctttgtataatgtttttctcttattccccaagatctttcattttcttttggaaaatgtggacagttagtctccatgtatatctctgtggtttcttactcttatattaattttgttttgagttgaatatcaattgaacttcatcaacatctctcattttttcaggttactcattcctgtttcagaaattgttcataaatgttcattattttcacatttggacacctaaataataatgatttaaactaaacatttatttaacttcaaaatgtatatactatttgccttttttatggtgagaatatatttgtataatacctatttatgtcaacacagcaactaacataataaatatactcttagattataaaagctcactttatataatcaaagaattttctttatgttataaaataactggtatgaatatgctatttagattatcattcaattacttacacctcatttctttcaaaatgtattggagatatttcccaatttgcaggtgcttggaaggttggagtgatgagtgtgtgtttgtgtggatgtgcttttggatgtgtatgcacacaaaggtttcttctttcctaatctaatatttcttttttcttttttggcctgacttctatacacaattttcttagcccttctggtaggttatttaggaactcaaaagtgctgggtattggctttcatgtcctgccagccttccttcttttctttgggagaatgttctgcattccaggagaccctgctcccaagcatcattcacatggtcaggctgtccaggtgcctctcaccccacttggagatgaggctgctctgttttcctactttggtaatccctgcctctgttctaagggcctggccaaaacatggaaagtcttactcttttttcaatccgatcttacagcagtgctggtgacattttattctaggtagatgtttgcatgaggcagttcttaaaaaaaagtttaaaaaaagatctttctgtctctgagcttttttcatctatttcctccttctgtcatatttccagaaggtaattgagagtcagttatgttttattttattttaacccagtgatacaggcaatgatgagtttgcatgttagtaaaatgggaaaatgagatgtgtagaggctgaggggcaaaatgagaatcggcacaaaaatctgattgatacaacattctgtgagaggcaagaatgtccctgttaggcaggaagccctgggtaagataacctggaatgggtgtatatgatcagaacacagggcaaaaaaaaccatcctcaagacttatcgccatatgaagactgaaagacaaaccaaccttctgagtgaactcactgaaaaaaatcttgtgtgcctggaaacattctgaaaggggcccctcccttgggctataaaatcaatggtgaatatcattatcaaatcagatatgggtaagcttttacagcatccagttcccagtgactatcccttaaagaacaaaacaaaacaaaaacaccactatccgtaggcaagtgttttctcttgaccacatatttacatatgaaagtctattctggggaaggacagtgaggaagatggaaaaatcaatgaaaagctccctctttgaatttgtagaggcctttctttcaaaggtgagcccttctgcacagatttgtttgcagagacccacacaggccccatatttatttagttcctatttgaaaagaagctttcctcctgccttagaagaagctcattacagatagacttcacctttctgttgcaaaagatgtttccttgaaatgaaaatgtaatgagtgttagatcagtagcatgtagctgccaggctatctctttgatccagtttggaatgcatttgttaaaaagctgctttattgatttttttagctgctttttgctgtgtttggatcatttgtacatatacacatcacaatttttgctacatcaaagtgcttaataagttcactgcactcaggaaatagcatacaaaacaaaggaactttgctctataaagatttctgcctcttaacctccagtatgaaagttgtttttaatgtgtttttttttttctgaatagcttcaaaatattttatgcagtcttcaatgagtcagccagggccccgcttcagatctccttctttgaaaatgatgcattctggaaaaggaaggatttgattgaacgagtaaacacatctcacatccattctgctggacaggagtcattttacttcaattaattatttaattggctcaatttgtgggtagcggcagcttccaggaaagtgttgacaatatttgatgtatgtgaggatagctactaatttagtaataagttgaaatttactaggtaactaatgtgatgtttgtttattaggtccaattatatgacaaagaatgagcacattataacctttaatgctgattttttttttttttgtatcatgtacatacaaatcagtgttaagtgcttttaactctaaacaggtatttcctgggggcagactcggagccagctcagtggaaagcacgactgggaagacagagctgagtttgctccacttttggtctcaggccaaaagtgctgactgtggtcaagtgtgggctgcacagaggagctgtccaatccagctttccaactagacccctcgtgctggtattcgggcaggctatacctcctgcagatgtacaaatgaacatgcattaaagattttatttacctcattcagtgagggagctaggaaaacattataaacagttgaaatggggatcaaaaccaacatttatttgtcagtaatagtgaaatgaatatgcaaatggagtcaaaactggtttttccatgggaatggtgtcggtggggagggaaaccaattaaacccctatgacaggtggaatttatggtgttcattagttacctacagactataggtttgtaaaatagctcaaagacaatgaaaacttagaatgtgataacctctagagtctagaaattgtggcgcttcccattgaagcacacctttttttgtacacctccaacagtggggcggacactcaaatccttttctttttgtctttaaagtcaggaaagtacgttgacttcaggggtcaggtgaaggtcaaggggtaagaaaataggaggcaggtgataattgtgggcttccagtaatattctggtaagtgaaaaggaaacatgacctaaaatagcaatgcatcaactgagtatttaaaagtcttttgtcttttctagaaattttgtcatcgtggtggtagttgatgtaaaaagtggttttcctactttgaattttatcttttattctctctctctcttttttcccctccctcctttctttccttccttcctttcttttttcttccttcctttccttcccctcccccctccctccctcccttctctctctctctttctttctttcttttccatgacctcattcagtgccagttcacattttcatcttgatccatccctttgtacattggactctcaaaaacagcaattcttaacagctcaattggatttgccatttggggccatctctgtacatggcctctaaataaatttacgaactccccttggtgcaaaattgagatatagatgaatgggtggctccctaagagaggaacggggacacctgggtctggtggaaccatgtcctgaaagcactatatgactttggcaaacagcactcttctctgggtgccatcccatctggtccccaagcagaagtcagagggtgcttagcagccatggcctggcctggctgcaaagggcatccagtcagcattgctttgtacactggagctttgaaccagtgatcctcaagcctctccagtcaggtcactgggaatttatactttcctaaaatgtccgttttcttgctgtttgcctcagaatgaaatctcacctcatgtgatagtagtcatgaaacccaaagacacaatgtggagaggagttcacgagaatgcctggtatgaggagagcaccccaaatcactctttatgagctcatctcaaatctcgggctccacttatcccacggtagtttttttgtttgtttttttgtagttataaagatataatttacatgtaataaaatttatttttaatgtgtatttcttcttttgaacatatgcttagagtcacactacaatcagataatgtttctgtgggacacccaaactttcctggtgccccttttttgtcatttttatccctggtctcccaactttagtaaccactgttgtgatttctgtctctatattttgctttttctagaatgtcatatcaatggaatcctagaaatgcaaacttttgagtctggcttctttcacttataatgcatctgagatccatcaatgtcgtcacacgcatcagtgcacgctgagtcgtattcccttgtataaatggaacccggtttattgtctcacctactgaaagggaggttgttgggttgtttttagtgatgggacatcatgaatacaaccagtagaaacgttcatttacagattttttatatgaacacagtgtagtgtttctgaattggatgataaatacgtgtttaattctataaaaagctgtcaaactgttttccaaaatagctaatctatttggaattctcactagcagtatatgagagttccagttgttccatcatattctcaccatcatttggtattgcctgcctccctcccttactcaatcttcttttttcttttctttttttccattatattctcaccattatttggtattgcctgcctgcctgcctgcctgcttgccttcctcccctccctccctctctctcccttcccttccctttttccttccttcctttcttttcctttcctttccctcccttccccctccctcttctctccctccctccctcctttctttctttctttctctttctttctttctttctttttcttttttctctctctttctctttctttctttttcttttttctctctctttctctctctctttctttttcttttttctctctctttctctctttctttctttttcttttttctctctctttctctctctttctttctttttcttttttctctctctttctctctttctttctttttcttttttctctctctttctctctctctttctttctttttcttttttctctctctttctctctctctttctttctttttcttttttctctctctttctctctctttcttttttctctttctctctttctttctttttcttttttctctctctttctctctctctttctttctttttcttttttctctctctttctctctctctttctttttcttttccttctttttctctttttccttttttcttcctttcctcctttcttgccattctactagatttcatagtgttatctcatacggtttaaatgatattaccttaattactaatatgttgagcttttttttttttctttacatgcttaaaatcttctctgttcaagtgtctgttcaaatcttttgactgggctctctttcaaaagctttccaattcaaattctatctttccaaaaatatgaattcattaagtctagaaagtatcgatcggcgtatttacaatgcctgtggatgcaatggcgaaacaaactcctagaacagattattttgtagtaccttaatacatagatattaaagcagtaatcaactcaagccagagtggattcactaagaatgaataatgtaaagggacccatttcctttctttttcatgaattaacttaattttatattagaatagttgaatagatatattttatttcatgcttgtgaacaaaatggagaaatatgaactgcgtaacaataggtaaattatattttgttgaaaaactattaccccaacatattaatctttttgaatctgtctagctggaggaatgttccttagtaattaaattcaaaataatgtaatcatcaaaaatattccaattaagtcaacaataattgttttataaatattattaaatgtgtatattttattcttattttagaaatatcacatattataataaatctggtatagtttcatgggagaaggatcctctgacattcatctcagaatgctatacttcacttaaagtttacttccttttgttatattaaccccacttcatgagatgctatttactctactttttttaaatgtgtatgcctcactttaatggtgttgcttttgttttttttaaaattgcttatctttatatttgagctttccttttacccggtgggtttaagtggcatactgcttgcttcagcctatttcgagtaattctgaggtagaggcaggacagattgcgaggcctgtcatgccaggagctgcaaagtctctccccttcttcctgggtcttggtagacacttgagtttctgccatgttgtcccttccacctccaggcgctgctcctgcctgagttctgcagccaagtgccctgtgattgctataagaaggaggaatgaggactggggggcggcgatgcagcaaactgaccagctgccacctctccattctcccagtcaatctctctgatcattgtctctgcgctagctcacagtctggaagcttggagagcctcttttgtttctccacttttttttttttctcagagttctctgtaaaagcatgttttgggttgtgctctcctgtttcaattaatttatatctaccctctgacttttaggaacttattatattatttgacaaagcacaaatgtgcagaaaaatcctaggcctaataaacccagatgttctggatgcagattcatgcttctctctcatgaaactccgcctcccaggccatcagggtgaaagcagggtggcagctgctgtgaggacagcgctgccatgcagcgctagagaccattccccacaccgcacctgctgccacggcaacaagcacccctcctgccctccccctttagaggatgtcatgtggaagttccataaaggcaaagaccacggagagctcatcagtggattttacccagtaacattttaaaatgtatttattccttcttcgtttggattttctgaaaacggagcacacatttcgataggcatcaagcagcctgttgatttcatgtgtactaactagcaattttcttcttatcagagatgcttattgaaacacgaggctttcatttcttaatacaatgacacctttttaatcagtcccgcacagctcttaattcaggagccagaatgtcagtgaataaagttctccttagaaagcagacctgacaattcctatggttcgtgaggcttcaccttcacccaggcagccatattgacaaaagccccaagtgtgttgcaaagtgggtgggtgccggtgttttgcctgcttcgcgttggaacacccgtcctctgtctggcattgctctgcagtaggaattttggtgggaaggaagaagttgcagaatctgagtcagcagagtctctatttctagatgtgcttgtagctactctatggacacctgacctagcttcttctaagtcagtgctcctcaactgagcacaagtttgaccccagaagtcatatggcaatgtcagcagacagtttcaaccataacgactgggagggagctgctggcatttagtgtgcaaggaccaggggtgctgcttacgcatactatgatgcatagaatgttcccacgaaaaacaattgtctgactccaaatgtctacagcgccaagcttgagaaaccctagtctcagttacagtacctgggagccagtggatctccagtgtcctgctcgggtcctagaaggagctgggagggggtagattgtggcctctggtgttctgtgatggcagcagcaacatttactcaagactcattctgggccgggcgcggtggctcacgcctgtaatcccagcacttcgggaggccgaggcgggtggatcacgaggtcaggagatcgagaccatcctggctaacatggtgaaaccccgtctctactaaaaatacaaaaaaattagccgagcgtggtggcgggcgcctgtagtcccagctactcaggaggctgaggcaggagaatggcgtgaacctgggagggggagcttgcagtgagccgagattgcaccactgcactccagcctgggcaactgagcaagactccgtcttaaaaaaaaaaaaaaaaaaaaaagactggttctgtgcctggcctttgttctgggtgttggcttctgcctggctgtcttagagtctatttctggtgtctcataaccattctttttttttttttttttgagacggagtcttgctctgtcgcccaggctggagtgcagtggcgggatctcggctcactgcaagctccgcctcccgggttcacgccactctcctgcctcagcctcccaagtagctgggactacaggcgcccgccactacgcccggctaattttttgtatttttagtagagtcggtgtttcaccgttttagccgggattgtctcgatctcctgacctcgtgatccgctcgcctcggcctcccaaagtgctgggattacaggcgtgagccaccgcgcccggccaataaccattcttaagttccgtgactcactagaagggctcacagggctcagggagactcaggactatggttcattacagtgaaaaaacacgcagtggcatcagcaaggaaaacaaatgcaccaggcagtgtctagaggagacccagcagtggcctccaaagtcttcctgtggatttgcgcaagacacactcactcctccagcaatgaacttcagtgatgtaagccaagtgtctaagcccagggagggcagcttgggtctcagaggctagagcttttatcaggagctggtcacacaggcacctatttccaggaggaaacgtgaccaccgtaaatcatgctattgacttggtacgaaccaactagataagcttgggcagcatgtgtcaggaccccgggtgtacaaaacaaccttattaattagcagcgcagggaatattgcagggccaagttttcaggagctggccaagggtcagttaggccttcctgaagagatgtgagactctggcactgtcaggcagctagctctttcctgcacactgcagttgtcaaaaacttcccagtcattctgtgctttcttcagtaacctttcagtgaagccctttctgctaaagtcagacaagttcagttatttctgcttccaaccaagaacaggagctgactcatacacaaggtaattcaaaaataataaccgaggcctcttgtgttgtttgcatggatcttgtatgcatgtgtgtgtgtgtgtgtttgatttgatttcaaaacgttatcatttctatcagaaagggagctttcttgaagacttcatgacagccacacatgagtccttgggctggtgttctagggaagcacattatctgcccgtggcctttaatgatatgcatttaaaatattttttctttttttaatagagccgaagacccaggacacaggcaaagactgcccatatcacatttttgacgtttgttgatatagagctctctgcccaggaaagactttagctccatctgtctgcatgttattacacatcccaggccacttaatacatccagcttagctgtggtctgaggtaccctgcttttcttaggtttgaaatgaatgcagctcatgcatgtaagatgtgtcataatctcttaggaagcaatatcaccactcaaaataatgaaagatctcggaaagaaagggtacgaatttgttggggaatatttagccatgttgtctgactttcttacccaccacgttttttgtttttcagagccattgaagataatgaagagatcactcttaaagtgctctttttttcttttcagattttaatagtaaagcagaactttaaaaaaaaataaagctgataaaaattattcatagattcatcatttagagaaaattgctgttaacattttggtatataatattcccatcaattttcttttcttttcttttttttttttttttttgagacagagtctctctctgtcgcccagactggagtgcaatggcatgatcttggctcactgcaacctccacctcctggttcaaggcattctcctgggtttacaggtgtgtgccaccatgcctggctaatttttgtatttttagtagagatggggtttcgccatgttggtcaggctggtctcaaacttctgaccttaggtgatctgcccgcctcggcctcccaaagtgttgggattacaggcgtgagccactacgcctggcccccatctacttttaaaacgtgtgtgtgtgtgcacatgcatacatatatacataatgtatataaaatatataataaaaacataaatatatatttatacatgtggcataagtgtgtgtatatagagatgcatgcacaggtagtcataatttatgcagcaatttatacataatgtatatcatgtaatcctgttgatgttcttctgaaacatgtgcctgtttcattgataccacatcgacctgcaatattcttctgcatcatggaagaatgtagaatggccgcatggtattccatctcatctcatacgatagtcagcacttccgttactggacatacaactgttaccatttatttgcagtcacatgtcaggctgtgattaacatgtttaatcaaatctatgtgcatatataattttacctccagactatatcttggtggtagaatttctgaaccaaagagtgagcacatttttcaaacaattgaaactcatggccagttatcctccataaaagttgttccaaatttcacacagtaggtcttttttcccatgaacttgccaatcttaatgatttctaatttttaaaaaatctcaacagtttggtgtttgtaagtagcttttcattataattaaaacaaccttgattgttaaggagtagccagaaaccctttaaacaaaaccttactggtattttttgtttgtttgttttaaatcaggatgtcagcctgtttaaatttaccaagtacatgaaaaggaaaacaaaacaaaaatttcttgactctaaaaaacccttagggtggtctacagcctgcatctctcttccatgacttccatgactgcatctgacttccatggcctcatgactgaggcctggggctgcactcagcaggacaggccaccttaggctgggcccccgggggcagtgccaggattgggactggggtgggactggttgacaggagtcttctcaaattatctgtgcatctcacaggggaatatatgggtgtgcttttttcctttgataggatggattaggaggactcagagtttttcttttgtgcaaggataacgatttgctccccaaattttgattgtctcatactcattccttttctaattatcccatatttgttaaatacaagataatagattctgacaagcaatcagcaaatgggcaccaagtgatgtgcttcattttaattggattgccttttttttttttccttctctgctaaattatagcccatcagcatgagattccctgtggtgagcagctaataatatgcccaggtgcagccaattttacttcctaaagaagaactagtagctacagatccccctaaagtgaagtggaaaagtgggctgtaatagctcgtctcagcagtgcggcatgctagggcaacttttacatccggatctctattctaacaatttttttttaatgcagtggcaattaatttgcattatattgatgaattaatgaggcacaggacagaaggttttcttagagacttctgagaaatctcttgtttaattttgccttagatgttacaatttttaaaaaatcttttttttaagaattaggaatataaaaccactatagataaacacaaatgaaaatatcactgttaaatgaaccagtgaaacagcattccatatgtattttccaaagtggtgctgggatgtggctttgctttggtgcacaaaccatagacaaatgtacccaatggaatgtcagttaggtttttgggaacacttttccctatttgccattaataatgtttgttcctatttaaaacattttagtgacttttaattagctacaatgaggtgagagtatatgttttaatctttatctaacttaattttatttttaagccacttgaccatgatgtgcagttttcagataaacccaaatattctttctgaggctgaatcaatagagattttcgtcatcacatactacacaccatctgtcacagccatctatctgttactctcttggtcaagtggccaccaatactcttgagccaacttgaaaacatatgggaaagacagtaaagggacaaggattaaagattcctgtcttaattcttgaacctggaaagaaaaaatgaaggaggagaaaacagaaatggagaaaacaacaatctcccctccctaccaagacagggagggttttcagggtgacctctcagtgtgtcttcactcagccactgccttccatattcctgccacattctggttcagttactattgtccacacatgtccttcttcccttgcagtttgtccatctccacacttcagccagagggattatcaaaaccctttgataacatataacagacatcctcatgctgtataacaaacatccccttaaaactgccattggctatgtttgtaaacatgagatttggacaggactcagtggagcaactcccgtctgctccaggatgcctaggacctctgctgggtagacaccaatggccagtagacagaaatctctttctcctcgcggcaaatctgacttggggatttgtagaggtcattgtcattcatgagctgatatttgcttctcttcagctcattgccaagtgtcccatccacatgctatctctagcatggtgctttctgggtagtcacacttcagggcttcaagagaatgttctcccaaagactggggtggactgcaaggcttctaaggacccgaacttggagatctcaggacctcacatccaccagattctcttggtcaagcaagtcagtaggaccagtcagaattcaaagagagaggggaattaaattataaatctcaatgagcagagcagcaaagaacttgaagacatatttaatttctataaaatcgtgttggatcatgtcaccctctaagcgtacaaccttccaaggcttcccattgcttttcagatagaatccagcactcaccccaaacagcctgtatgttcctgctgaccagactcatctcacaatgtgctctctgagtcctgctctgtgtatttcaaatccactgatcctttatttctctaactatggtggttgtcccacctcatgttcctctctttgcacactgtttagctaaagccaagctatcttccaagtctctgtttaaatgtcacttagtaggggcaacctccactgacccatgggtgcagtcaagcttccctgtcttagcatccagaattatcaaataattagttgtgtgatttagtatatgcttcactgaagtcccatgagggcaagggcatagtgtgtggttcagagctatttgcatagcacctagaaaactgtcctgcacacagttggcacttactaaatatttactaatgagtcaacattacattagccaaccttaggaaagagtgcttacctgtgcatctcaaatgacaccaactttgtgaaataatagtctcctgagacatgctggatctgcaccatccagtagggtagccctggccacacacagtgttgggcagtcaaagtatggctggtctgaattgagggtgccataaaatacataccctttttcaaagacatggtgtcacatcaaagggtatcaattgtctcattgatatttcatatgaattacatgtggaaatgataatagttttgatacgctgtgttacctaacagtattattaaaattgaaaactaggccgggcacagtggctcgcacctgtaatcccaacactttgtgaggccaaggcaggcaaatcatgaagtcaagagattgagcccatcctggccagcatggtaaaacccagtctctactaaaattacaaaaattagctgtgggtggaggcgtgcacctgtagtcccagctacccgggaggctgaggcaggagaatcgcttgaacccgggaggcagaggttgcagtgagccgagatcgcgccactgtactccagcctggacgacacggtgagtctccatcccaaaaaaaaaaaaaaaaaaattgaaaactaatttcacctgtttctttttacatttttatatgactttttgaaaatctgaaaccacatatgcagttcacatttatgtctcatgttatattttgtgggacaaagctgctctgaagagaaggttctagggtgaaatgtacttggagaaattctgcaagcactctcactctttagagggtttgcaatgaacatatcaaaagccctgagaagtcctgcagcaaaactgctgttaactctaagccagtgcatttcaaagctgactggaccttgcataggtctcatctttttaagaccttggatattcacctcccatgaaacacacttagggaaacatgattaggtgacggccaccctgatgcctggccctgaggtcgtggacatggttcatgtaaaactgaatcttattatgcagattagaggcagagcctatggaagtgcatttttattgggggaggggaggggatggaatcagacacaggagaagtgccaaattcaagcactttggcagaatcacacagccccacacataaagtcgtataagcacatatgttcccaccggaagctggaagccgcttctactctgatggaggggatggggccttgccagccccagggtcatgggcagcccgtgctgggctctttacagacatctagggctgttccttggtttgccttatttctctagtttgctcagtttgctgaaggggcaaaccaaaggtaggacacaagttcaggtccacaacggctgggtgcagtgtccgagatggaggggagaaatgtacaccgagtggccgtcagggcagcagatggtctgcaatttcctcccagaaatgtgggcatttttttctttctacagtaaagagtggatattgtctcgctgggctttctgaatttcatttttgatgagagatttaaatatgctgtttctcagcccagaatcctcgagatgttcgtgtggactatgtcccaagccccgtgcttgttttaaaggtgtttggttgtcaagaaaggtatcctgtgaacctaagaaatagtccgtctccctatgaggcaggattgtggcctcttttaaattaatcccacgtgaactgtgacctctttgttggactgtcaccagaatcatcttgatataagagcactgagtaataagaatctaaccagagcttgaggcagccgtgatagtctcaccaccatctgcccatcctggagctagactttcccaggcaaggcctgcctgtcctctgtcaaagcaaatgctggcctcccattagctcctaattctaataagggtttctattttatccacttacctctcctccagttgatatttcccaacatcttttttaccatcttccccaacaattcagtcctaacaatgctctccccttcctgagtcatctttccttttctcacagaagttcatcccttccacactgcaggattagaaagatcactaccttgtgttattctcacagagcagagatgccaagcatttccccacaagcataaatcttaattgccgtccttgctacaaatcataaataaccctagcccaggtatcattgcacagaaagccaggcaaaggagacagaaagccaggcaaaacataatgaaaaggtattaattgataactaaacaggtgttctatcttgctccagtacaaattttatggcaacaattttgttgaattgcttcttctggcattgaaaatttcatatgatgtgcatagtttcactctttctaaacccatctggggaaacaacaacggcaaaatcgtgatttaaaaatctgaagcaggctgggcgcggtggctcatgcctgtagtaccagcactttgtgaggccaaggcaggtagatgacttgagtccaggagttccagtccagcctgggcaacatggcaaaatcccatcttttctaaaaatacaaaaaatagctggtcatggtgtcacatacctgcagtccaagctatgcaggggcctgaggatggaggactgcttgagcccaggagctcgaggctgcagtgagccatgattgtgccactgcactccagcctgggtgacagagtgagaccctgtcccaaaattaattaattaattaataacaatctgaagcaattcaacttattcaaaacactttacccagaaagaacttgcaaattacccagggtgaaaacgagtggtagctcctggaattaataaccttaaatttaaagaagagaagaggtccctggtacacttcaaaccaaaattgttgtatcctttaagagtattgcaaagttaactttctaaatatgtgaatttatttaaatttcccaacaattaaaatgaatcaatgtttcccaaattgtgttccattaaatacttctcagggagagtttgaaagttctgcatttgaatatgggctttgatggtcaatagacttgaaaaatacctcatagtagagatctactaagaatacaacgcatacaagcacactaaaagtgctgagatattctgttgtcaacacacctgtttcacttcagctaaccttttccagagcttatctgggcacaaaacagtttattttgagctgtatctcttatttttccttagaacaccgtttaggaaatgagaaaatatacaatgttacctggtatacaatggcacggtttcttttttgttactctgctcaacacacctaaccatttctccctaattttaattttgcatataatcacaggatattttgctgttctttgcagtttcaaatatattttcaaaatattaatttttatccctaatgccagaaaaatacactgctatggcatttcaaaattgtagccatgaaatagaatgagatgtgatgtcatcacgtttttaggataatttctcactgccactagaaaaatacttcagcagaattcatgaggattatgtatattttataatcagtctcctcctaccatttatggtgctctttagaggtgataattctgtcttttgaagatctctggatcacaggaacaagagtgatggcaacaccaagagcaagccagggccctcctgaaactccccccttcctcactcactcttcactgcagcctctgagaagggaccttggccctgtaccaacttccttctccatccaaagtggcacctatggaatggcgcctctcaatgtgggaatattctaaccaattgctttgtattagttcattaccttgctgctgataaagacatacccgagacagggtaatttataaagaaaaagaggtttaatggactcacagttccacgtggctggggaggcctcacactcatggcagaaggtgaaaggcacgtcttacatggcagcaggcaagagagaatgagagccaagtgaatggggaaaccccttataaaaacatcagatctcatgagacttattcagtagcatgagaacagtgtgagggaaacccccacccgcccatgtttccattacctcccaccgggcccctcccatgacacgtgggaattatggcagtacaattcacgatgagatttgggtggggacacagccaaaccatatcatgcttcttttcatttttcccctaaagaaagaatatcgctttctaaaaagatgaaatccctgaaaagatggaatttatttcctaaaaaaaaaaaaaaaaaaaatcagaattaaagggagaatgaggcatatgaaatttggatccaaataacttgaagcacatttcttatatatgatgttctttgtagaattcctttgactgattggaaccatttatcttgctgtgatttcacagcacaggcataattgtgattgttttattagttctttttgctgattaactgaaacataattgtgctttttgaaaaaagagtgtgaagttagttgatttctgaaaaggtatgtaagaatgtaaacacgaggattcttaatatcagtggaagaaaatgactcagtggtgggactgtgttttcacactgctaataaagacatacccaagactgggtaatttatacaggaaaaaggtttaatggactcagagttccacgtggctggcaaggcctcacaaacatggtggaaggcaaggaggaccaagtcatgttttacaaggatggcagcaggcaaagacagagcttgttcagggaaactcgccctttataaaaccataagatcttgtgagacttattcattgtcacaagaacagcacaggaaagacctgcccccatgattcaattacctcccagcaggtctctcccaaaatatgtgggaattcaagataagttttgggtgatgacacagccaaaccatatcagactgaaaacagagcagagagatgttcattccatggaagctaaaaggtacatttgctctgagctgtgagctcgcatacagaagtgggctgctcagctactacagcccaggtcacactctgctgtctcctggctgtgtgaccttgggcaccttctttaactcccatgcacccgtttggtaaaacttggggctggcctgggttggaggccaaattcaaccacaagccagccaatgttagccagctagaggatttgtacttgacaaatatttgtgtttgactgttgacctgggcaatgtttaaaaatttattttgaatagttgccaacactaaacattttaaaggtaacataaaatctggatttccagctcctctggaagaattataaatctggcaatgcaggctctcattcccacctggcagctccagcagtggctttggtgctcttcactccagctcatcaatgtccccatcaccccctcgtggccccaacaccaacactgagacagagtaccagctgccaattgtgtggctgtctctttattataattcagaagcattaaatgatttatgatattcatattcctatctaaagtagagtatttgtttaaagaaaaatgaaatataacatttttatggaaataagaatgtgcattggctgggcacagtggctcacatctgtaatcccagcactttgggaggccagggtgggtggttcgcctgagttcaggagtttgactccagcctggccagcatggtgaaaccctgtctctactaaaaatacaaaaattagctgggcgtggtggcacatgcctgtaatcccagctactcgggaggctgaggcagaagaatagcttgaacctgggaggtggaggttgcagtgagctgagactgcaccactgcattccagcctgggcaatacagtgagactgtcttaaaaaaaaaaaaaaaaaaaaaaaaaaaaagaatgtgcattaagcacatatataagtgaagaacatattttttgtttaaaacccattcacctttgctcatgtttactaatgtcttggcccctgatggcctttcattctgtagcctgtatagagcagggatcagcaaaatggggctcacaggccaaatgtggcccaacccctttttttgtaaatgaagctgtattgggacgcagccatgttcacttattcgcattttgtttatggctactttcatattacaataggacacttcaggagctgcaatagagactctgtatctctcaaagccaaaaatatttatcatttggcccttcgtaagaaaaagtttgctgactttgattttcagcgagggcacccagagagcttggaagtgattactcctgggctcataacatgaaaaaaagctgaacagaatgaaaatctatgacttttctggattcatcagaggattgaggtcacagggcaaaccactggtctgcaatctggagagacaggtcaacacagagaatgagagccaaggtcagcttacagggggcagaagcttgcggagccagtgattggtaggaacacgtaaatggtaagttcaatgaattgctggagactaagtatgtgaggcttgagagttaatatttcctaggagcccctacagctttcttgagtttttcctccaggaagctcaccagattctcacatgaaggtcagagaaaaatcccctccagttctgagcatgggaagtgagaaggtaagtatttgaagcaagcccattgcattctctataagaaaaccatgtccttcaaggaaggctaccttaccagaacattgtccaacttgaggaaaggaaaattagccactggtgcccccttctatcctgcctgcctcacataggaggaggaagaaaagctaaaaaacaaacaaacaaataaacacaaccacaaagcacatctgaaagtcacaatccagggacttgggtatactgcaagctgagattttatcttaagagtatggagagcttcctctccctaacacctcagcatcacatcaacaaggctccaaaataataccagtgaattacagctaagagagctgcaagatgcagcctctattcaagaatgagttcctagggaaacacaaagacaacaagagagaaaagtgagataaagaaactaaaggctgtgtcacctgcagctacatcaaacattaaatacagcccagattcatgtaaaacctcatgctaaaagtctaattatattagctttcattacccaaatactgtgtctgactctcaacaaataatgacaagaaatgaaaggcaagaaaaaatacatatgaagagacagaataagcatcagaaccagactcatatatggcagtgattttggaattattggatatggaatttaactatgattaacagaattagggttctaataggaaaagtagatgacaagcaagaacagatggataatgtcagcacagaaatggaaactctaaggaagaatttaaaggaggtgctagaactcaaaagcaatgtagcagaaataaaaagtgcctttgatgagctcattaatagactagatataaacaagaaagaatcaatgagcttgaagatacgtcaggagaaactttttaaaccaaaatgcaaagagaaaaaaaatgaatggaaaaatagaaacagactgttcaagtactctgggacaattacaaaaggtataacacatgcagaatgagaatcccagaaaaaggagaaaagggagcagaagatatatttgaaataacaatagctgacagctttccaaaattaatgatagacactaaaccacatatccaagaggctcagaaaaaaaaaaaaaaaaaaaagaaatgcaaaaaagtctacacctaggcatgtcatatccaaactgcagaaatctaaagaaaaagagacaatattgaaacaagccagagaaaaacaccttacctgtagagagacaaagctaagaattatactggactttttgccacaagctacacaagtaagagagtggagtgaaatgtacagtattgaacaacaacaacagtaacaacagcaacaaaaaacccaccaagatagaattctctgtctacataatgtttcttcaaaagtgaaggagaaataaagatttttgtcagacacaaaaaaattgagggaatttgttaccagtaaacctgcctttaacatttaagaaaggttaaaagaatgtattcagaaagaagaaaatagcatgggtcagaaattcagatttacataacaaaaggaggagcttcgtaggaataaatgacagtaaaataaaatgcataagcagaattagaaaaacttgctgttatagttaggggcttcagcacccctctgtcagtagttaacagagccagcagacagaaaatcagtaaggttatagttgacctatgtaacaatgccatcaaacaactgaatctaatttacattcatagaatacttcatgaacaacagcagaatgcacattctttacaaattcacatggtctattcaccaagactatattctggactataaaagacatctcaagaaaattaaaatcatagacatcatataaaatatggtcttgattataatgaaattaaacttcaatggaattaaatttaataacataaagacagctgcaaatctctaaatatttggagaataaaaatacacttccaaataacacataagtcaaagcagaaatctcaagggaaatttaaattatttgtaactaaatgaaaatataacctatcaaaatgtgggatgcaatgaaatcactgcttcacagaaaacttataacattgaatgcatagattagaaaagaaaaaagatttgaaatcaatagtcgaagcttccaccttagaaaactggagtaagaagtgcaatatcagcctaaaacaagcagaagaaagaaaataataaaacttagaccagaaatcagctacattgagaccaggaaaccagtagagaaaatcagcaaaactaaaatctggttctttaaaaatgtcaataaaattggtaaacctctaacctggctatcaagcaaaaagaagacatgaattattaatattggaaataaaagagaactcatcaggaatgctttcatagatgttaaaaggataataattaaagggataatagggttatgaaaagccctgtagccataaatttgaatacttggatgaaataaactaatttcttgaaggacacagactatcaagatttgtataaggagaaacagatattctgaatgggcctatatcaatgaaagaaattgactcaataattaataaccttccaaaaaagatagcatcaggcaccagtgtttgcactagtgaaatctaccaactcttaaagaaaaaaaatgataccaattctttgcaatctcttcctaaaaataaaagctgagctgacgttatgtctcatgactatgatctcagcactttgagaagccgcagcgggcggattgcttgagctcaggatttccagaccagcctgggcaacatgacaaaccctgtctctacaaaaaatacaaataattatctgagcatggaggcacatggctatagtcccagctacttgggaggctgaggtgggagaattacttcagcctgggagacagaggttgtagtgagcagagatctagccactgcactccagactaagtgacagagtgagacccaatctcaaaaaaaaaaaaaaaaaaaaaaaaagtagaagcagagggaacatttgctaactcatttgatgaggccagtattatcctaaaaccaaaacagataaagacatcacaagaaaactacagatcaatagctctaatgaatttagatacaaaattactcaataaaatactagcagattaaatccaacaatgtataaaaagaataatgtaccatgatgcatttggatttattccaggtattgaaggatgctttaacattagaaaatgaggaaatgtaacctatcgcattataataggctgaagaatgaaaatcatatgatcataacaacagatgcaaaaaagaatttggtaaaaccggcacttatttatgataaaaatgtctcagcaaactaggaatagaggggaacttcctcatcttggaaaaaagaatctacataaaacctataacagacatcatacttaataatgagaaaataagtttcttccctctaagattggaacaagtaaaagattttccttttcatcactccttttcaacattgtgctggaagtctgagctaatccaggaaggcaagaaaaggaaataaaatatatacagattgagaagaaataaataaaattgtccttgttcacagatgacatggtagtctatttgaaaatctgaaacagttaacaaaaaaatttctggaattaataagtagtcatagagggttgcaggatacaagactaatatatgaaagtcaattgctttccaatgtaccagcaataaacaattggaatttgaaatgaaaaaccaatataatttctattagcaccaaaaaacccacttaaatattaatctaactacatctggacagtatttacatgaagaaaactacaaaactctaatgaaatagacaagatatatagaaatggagagagattctattgtcatggacaggactcaattttgttacgatgtcagtttttctcaacttgatttatagattcagagtcatcccaatcaaaatctcagcaagccaatttttacacattgaaaaactgattctaaagcttacatggaaagctaaaagacctagaataggcaaggagatactgtagaagaaccatgagagaactgacattacctgacttcaagacttttggtaatcactagcttctggtgttggtggaagaacaggcaagtaggtcaatggaacagaatgagggctcagaaacagatgcacacaaatatattcaactgaatattgacaaaggaacaaagacaattcaatggggaaaggatagtcttttcaacaaataatgctggaacacctgaaaatccatgtgtgaaagaaactagacacaaaatttagcaaatattttacaatacgtgctttaacaacaacaacaaaaaaactcaaaattgattagagacccacatataaagtgcaaaacaatacaactactaaaagataatataggaggaagtctaggtaaccttgggtttggttttgactttttagatacaaccgcaaaagtatgacgaatgaaaggacaaattaataagttggtgctatggtctggatgtatgtgtctccccaaaattcatatgttgtgatagtcttaggaggtggggcctttgagaggtgattaaatcatgaggtctctgccctcgtgaatgagattagtgcccatataataaagaccccagagagctgccttgtctcttccaccatgtgaggacgtagcaagaatcaccatctatgaaccagaaagcagctccacacaagacagcaaatctgctggtgccctgatcttggactatccagtctccagcactgtgagaaatgtcagttgttcataaattacccagttgatggtattttcttatagcaacccaagctagctaagatagtttgacttccttcaatttaaaaacttctgctctttttattgttgtatctctgccaggttttggtatcaggagatgatggcctcataaaatgagttagggaggagtccctccttttcaattatttgaaatagtttcagaaggatggtaccagctcctctttgtaactctgtagaattcagctgtgaatccatctgattctgggctttttttggttggtaggctattaatgactgcctcaatttcagaacttgttattggtctatccagagatttgacttcttcctggtttcatcttgggagggtgtatgtgtccaggaatttatccatttcttctagattttctagtttatttgcatagaggtgtttatagtattctctgatggtagtttgtatttctgtggggtcagtggtgatatcccctttatcgtgttttattgtgtctattcttctctcttttcttctttactagtctatctagcaatctatctattttgttaacattttcaaaaaaccagctcctggattcattgatttttttgaaggattttttgtgtctctatctccttcagttctactctgatcttagttatttattgttttctgctagcttttggatttgtttgctcttgcttctctagctcttttaattgtgatgttagggtgtcgatttgagatctttctggctttctgatgtgggcatttagtgctataaatttccctcttaacactgctttagctgtgtcccagaacaatgataacacatggacacagggaggagaacaacacatactgaggccagccagggggttgggggccaagggagggagagcattaggataaatagctaatgcatgtggggcttaaaacctagatgacaggttgataggtacagcaaaccaccatggtacatgtacacctatgtaacaaacctgcatgttctgcacttgtatcccagaacttaaagtaaaataataataataaaaaaaagccttctgctcagcaaaagacacaattgaacaattgagaacgttaaaagacaagccaaagatggagagaaaatctttgtgaaacacatattggaaaaagacttgtatccaaatatataaagcagccttaaagctcaacaatgtgaaaacaaatgatccaatgttaaaaaagaacaaaagatctggaagatcacctcacctaagaagacacagaagtggaagataaagatatgaaaagatgatcagcattatatgtcgttaaataattttaaattaaaacaataacgagatactactctatagctactaaactggctaaaattcaaaaaacttacaatatcaaatgctgatgagatgtggagtaacagagacggcagagtcactttaaaagacagtttgggccagtcgcggtggctcacgcctgtaatcccagcactttgggaggccgaggtgggcagatcacaaggtcaagagatcaagtccatcctggccaacatgatgacaacctgtctctactaaaaatacaaaaattagccgggtgtcatggcgtgcacctgtaatcccagctacttgggaggctgaggcaggagaatcacttgaacccaggaggcggaggtttcagtgagccaagatcgtgccactgcactgtagcctgggtgacagagtgagactccatctcaaaaaaaaaaaaaaaaaaaaaaaaacagtttggcagtttcttacaaactaaacatagtcttaccataggatccagcaatcacgcttcttggcattcatgcaaataatttgaaaacttatttccccgtaaaaatctgcacatgaatgtttactaaaggcaaccgaactaaaatcaaccgaagtgttcttcagcaactgagtgagtgaactgtggacttttactcagtgatgagaagaatgatccatcaagctacaaaaagatcaggaagcaccttaaatgcatacagccacacaaggaaagcaagtctgaaaaagccacatcgtatgtggatccaaccatatgacattctggaaaaggcaaatgctgagacaataaaaatgtcagtgactgccagggatgtgaaggtggcaggtggggaaagatgaacaggacaaaccccagggatttgtgaggcagtaaaactattctgcatggcactagcatggtgaatacatgacattatacatttgtcagaaggcacagaacgtacaacacacagagtacagcttaatgtaaatcgcggcctttagttaacagcaaattcctcacactgttgcaagatgttcataatataggaagttgagtataggggagtggcaggggacagtgcatgggagctctctctactatcgcctcaatttttctatacatctgtaactgttctaagaaataggccgggcactgtggctcacgcctgtaatcccagcactttgggagactgaggcggatggatcacctgaggtcaggagtttgagaccagcctgcctggtcatcatggcaaaaccctgtctctattaaaaacacaaaaaattagctgggcgtggtggtgggcacctgtagtcccagctacttgggaggctgagggggaagaatagctagaacccaggaggtggaggctgcagtgagccgagatcatgtcactgcattccaggctgggaggcagagtaaaactctgtctccaaaaaaaaaaaaaaaaaaaaaaagcctattactgtaaaaaagataggttaaaaaaaaaaaaaaaaccggcttgcaaactttgatttagaaccatgaacctttttatcctaaaactctgtgaaatacttagtaccccatttctgtcattaaaccaacaaaggagacatttcgtttgaagaagatattttcccaagaaataaaacataaatatgaaatacacaaggtcatgtaggaaaagtagattatttttctttaccctgtgaatattgctctcagggtgtagcagtgccctccagtcaggcaaaaattagttgaagctagtaatagccaacctggcttagaaataacggctaaatatatgcattatgttgtgagtgcttactatttattgagagtgtgttttattagatttgggtttctgaaaatgtgataaattaattgggttggtaaaattaactagcaaaaatatttgtaaacagctataatcttaattacaaatgagtttataaactttcattttttcattttaagggaaaagacaagtgtagaagatgatgctgtttattttatttttaatataacatcatgctgccttacctattatcttttgatgaattctggaatactgaggaacatgagcatatatatatatatgaaatatttgtaaaatgaggaaactgggagctattttatttttccccaagagtgattttcagctataaaactgtaatgtggtcaggtcgtagatcacataaaaatcattctatgtttcccttaaaattatctaaatagagttcactagtttttcttaatgtgcacatttcgtatcacccagtatggtcaggggtgcaggaggtaggtcatcttcaagacattttcttgttgcaagaaattaccacaattctgtgttctgttgttcttgtttttaagatatttacctgccaagcatacggcataattatactttccaacctctccaattaagaaagaacttttggttctttgtgctgtggaactctgagtagataagatgttttttcttttagctaactgaataatacccacaaaattcaataagctctttgacaaaaatggccattgagggcctctgagtcaccttacgctcatcaactcccacccgtcaatgaatatcagaatatgggctctaatatgctttaaaattagtccttccttaaaaaggtgtcatgtaggggaagcactcttatatttgaaagcaagtatcagaaagctggagagtggtaccgatcctgcagatataaaaatatctttagtgtttttctaaaacatctacttttctaggtagtacctgtctattattaggggacaagtgagtcagccgtgttgatgtgacgatattagggtccttcttgctacaagctcatgtgccattttaaggcttacccccagagcatgggctcagcaaaccactgcagagaaaacaggctggtcctagtgctctgccttgtgctagttcttgcgcaaaggaaaaccacaggccagcagggcctaagaatcagtccagacacgcacatgcactcacacagagcacagaggccacagtttgccgcctgtggatcccattaccaacagggatgactttaggtaccaggatacttcgtctcattcaggtcaaaacttttactttgcctaaagcatttctcattcgcgatgtttggatccaaagactgtagtaatgctacaacttgcttgcttctttgctattttcctttcttttaaaaatggattctcatcagaacatccctttcaatgtaataaactatatttggatctgatcctcttataaattggaaccagagtatgtggttaggttgtgcctcatcttttctgttgataagtgttttatgtgaggaggttcagaagagctgactttcagctacaaaggttgtgttcccgttcctgaggcaaacagcaccctggccttcagggcagagcttggctgggcctttaagcactgggagtcttttgcacaccttcgaatagagatggctcttggaaacccagtatgtgcctttccctagcaatttctcttttcttttcttttttctcttctctcccttcccttctcttttccttccttccttcctcttttcttttctttttttttgagacaggatctcactttgtcacccaggctggagtgcagtggtgtgatcagggctcactgcagccttgatctcctgggcgcaagtgatcctcccacctcagcctcctgagtagctgggactgcaggtgtgcaccaccatgcctggctaatttttgtattttttggagagacggggtttcaccatgttgcctaggctagtctcaaactcctgggctcaagcaattcacctacctcagcctcccaaactcatggaattataggcatggatatggaaagaaatgcatagcagatggtaaaataagaaggaaacacaattgcacttggtggcaccaaagaaggcctgccctgtgctgcctgggctagggggacttcagaaggtgtcctatttgaaggtgcacccagtaagtgttggttgctcacctcacccaatacctacctgtccttccatcagggagcacatagaattgggctcaagagcatgaaacattctcaagcgatatctctttagcatatggggttccctctacaaagactgaggttactgtcttggcatcagcctcccctcccctgagtaacaccaaaaacacaatcatttgttccatttgctggacccagttgagagcccacatctgttactgtagacagtcaagtttttatctacatacaagttattgattatctacaagttattgattatgattatggcatgcgaccctctgttcacacctaactgtgctccagcatcctctttaggccatcatcccaacattatctctatggctactctttattaccccctaccctgtgccaaatattgtgctaactaatggcctgacagctgttattttattgaatactcacagcagtcttgagacagtcgttagtgtttttatttttcagatgataagagtgagattcaaagaatacaagtatcttgcccaaggtcatattcctgaaacgacaggccaggattactgcccaagtgagtcctctttaaacccaggttcctgtccgctattgtgataagctatgtcacactgtaaaattagtctgctggttaccttccagggactcatggctttgcagaatctccacccaccagccacacatgtccagactctattgcacagtgtattattgttccaaatctaggattgattaatattttcctgttttacctttaagaggatgacccttttttgactttatcccaataagttttgaggtaggggcatcttcctacaggccttatggatgaaaataattctccacaattttaagtatgatagccacctgagattaactgaaaaggggcttgtaagaaagcagaattttgtttcaaatatagggggataaatgaatggacctaagtaactttctgaaaaagcataaacgaaaacaacaacaacaaaatatgctatttaacctgtgttcataggagtcgattaaaaccttctattttggaacatgagatttagcggaaaacatctgtagataggtagcaaatgttagcagctatttaagatgtaagtctgacttactgatgaacatcagaaatggatcactcggtcgcttggaaattcaacctccatttcctgtgtgtaaagtaagctgaactggctcagactgagcattctagctctgaatagtaaaataacagtgaggaactcatgaccatgatacatgatgctttcagataattttaaatagttttataatattgaaacatcatagcctggtatagtggctcatgcctgtagtcccagcactttgggaggccaaggtgggtggatcacttgaggtcaggagctcaagaccagcttggccaactggtttcaccagtaaagatggtgaaaccccatctctactaaaaatacaaagaaaactaaccagttgtggtggagcatgcctgtagacccagctactcgagaggctgaggtgggagaatctcttggacccaggaggcagaggttgcagtgagctgagatcatgccactgcctgccagcctgtgcgacagagcaagactccatctcaaaaacagaggaaaaaaaaaaaagagaaacatcatgaaaaggtgaaggattggaatgctgatagttgaggctacaaaaccatgacataagtctaggagtttggcctttattccaaggaccaacaatttcaagaattattaatagcacagacttaataaaaaaaaattaaaaaatccttttttgtgaagttccaatatataaaacatatgctttaactcttaaatagtgtagtttaagttaacaggtttctaaggcagtaccacacttcagtttagggcagaaaatacttttagtactaattttgaactctaatccagaaactattttggctcttcaaacatttaacttcgtcaaatgtattttgttttgcatcttttaaaacctcgtttccatttaatcactggtacaatatctgcaattcattagctcaacaaatatgtgcgtgcttgtgagttcttctgaactcttaagggctggggacagcaataagttagaattcgatctgtgtcttcatggggcttatattctgtgagagggaaggacaataaacatataatccatggtgatacaagtgcggtgaagaaaataacccagagtgatgctgtagagatgacatggggtgagggtgatggatgagatggtcaggaagggttctccaaggtctcccttggcaagtgacatctaagtcaagacttgaatgtgaaggaagaagccagaaggaacagcatgggcaagcacacagaggcaagaaagagtttggtgtattggaagaacaggaagaaggggtgtttcggagtggacagttaaggaagtggtcagtgaagtgggagagacagggaggggtgaaaccactacaccttaaaaatgatagcgaggtctttacattttatttcaattggagcaggaagccattgtccaaaaccaaataataacttgaccttttgcttcctatttgagtctctttaacttattaaaaataagacatacaagctcatatgagtatgtgatatttgatagatattgagttaatatagtttatcagatatttcaagtatttgaagtatccttactgttaccttgccttaggataactacctaaactccttacagactaattgcattatcagagtaatttctcacctgaaaaatttaacattttatatatgcaaaagtcagattgaaaaagaaaacaaaattgtacttagctctaaaactttaatggggtattactgccttcctggatgttgtagaccaccttcttaaatgtgacacatttagcaattctgaatgccagcaggatgttgtagactaccttcttaaatgtgacacatttagcaattctgaatgccagaaggcagctgggccatgggggagagtcctggctaaggtcaaagtaagaccctgtccctttcttgctctttaattcttgggcagataatgtagtttctatgacacataattccttcatttgtaaaatgggtccaacaagctaatacatattattggtaagctattagaaatcgaatgcattttctccaaatagcctgggccatttgtattgccaacgtatacttggcatatggttaagggattgaagtgaaaaatattaaattagaattcagtttgtccctattataactatgaccacttcttgggaacaaccctagagtttatgtatatttataccttgttacctcactttgttctttccaaactcatttttaatagaattattccaagaaatttaaccctagtggacactttctattccacacaatataacataccctcacaagtacactccttttatctgtttcaaatgtctgtcatactgggatagaaaacaagttaacatacaattttcctctttacttatatcgaatggtaaggaggcttttaacaaatggctttatataacaactagtattgcgtgtttaggtaacaggtggatactcagtactttattggcaatggtgatgagggaattttgatcttggaattcccagcctcctgaactatgaggaaaaatatttatgttgtttataagtgtattattctgtttccagactgggtaattaataaaggaaaaagtcttaattgactcacagttcttcatggctagggaagccccaggaaacttacaatcatgatggaaggcaaaggggaagtaaggcaccttcttcacaaggtggcaggaaggagattgaatgcaggaagttctaccaaacacctaaaaaaaatgtgatctcgtgagaactccttcactatcacgagaacagcatggggcaactgcccccatgattccattatctccacctggtctctcccttgacacatggggattatggggataatggggattacaattcaagatgagattttgggtggggacacggccaaaccatatcaataagccatggcattttgttatagcagcctggacaaactaaggcagttggttagaatacatgtttttaaggcaaagatgaggaaagggaagaatcctggacctcaccatgataaccagatggtttagacagggcaatacccctctaagatgctgcttcacctgagaaatgaggaggataatattggtacaggactttcagaagtgagataatgttcaaaagttacaaaagggagacccaagtatagtctcttgttagtttcttagtatttttgactttgagatttattttttaaagtaatagtaagtgacattattattgctattactagctatatcatctattggctggttactgtcaccagcactatacaaaatcctttaaatatgttacctcatttactcctcacagtgacaccattaagtcagagctgtttccccacattttacatgaggaatctgaagtcagagagtttaatcaactttccccatgttcacactgggagcagagtggtggagatgggatttaattccagctgtaaatgcatggggcagaacccctgcaggggctccatggctcattaatgtgcccctctggcccaagcatgggttaagaaagtggacctaatgatagagcactaaataggggatattcgaatcttgcatttatcaaagtgccattgtccatatcatgttaatattttatatttacatacttccatgtaagtcgcagacctgggatatgaatctaggcctttgagcctaggcttggtcttccctgtgggtaaaaatcctgttgcactttgggtctatttcttagttacattggagattcatattcagtgtttggaatttcttacaaaatgacggaaactgcctactaattcccattgattgaagacacaatatctaccaattcagttctcaggaagaggagttattaggtttaaatttatttttacatcttaaaagaaactgctgagtgataggagaggagagtgttaacttggagtgacagattaaaaaaagtgagccagttcatttgtacataatttttggctatgttatccagacataagctaccagaggacaaagcagtgtaataaatctaatattctcaaatagtttgtgtgcagaagtttagcagtgaggatggttttgtaatgaccgcacatgctagattgcaaactccattcttcactattcatgtacatttgatgtcatatacattgccaaagatgatttcaaaaatgccaagcttctagtctcactttccttagttatgataccttatatcttaaaagggtggtaatttattagttggttttttgttttttgtgtgtttttttcttttctttttggagatggagtcttgctttgttgcccaggctggagtgcagtggtgtgatctcggctcactgcaacctccacctcctgggttcaagcaattctcctgcttcagcctcccaagtagctgggattacaggcacatgccaccacacccagctaatgtttgtatttttagtagggacggggtttcaccatattggccaggctggtctcaaattcctaacctcgtgatccacccacctcggcctcccaaagtgccgggattacaggcatgagccactgtgcccgaactaatttattagtttttattatttcattttgtttagatagaaagcatggagttaaacattaattgtactgtattggctgccaaagcatagaaattgtattttggaggtgagagctgcagggtgggttgctgtttcttcactgattattccccatgagaaaaaagtgacttgttgattgcaatttcgttgtgaataatagttattttcatggtctttggaaaacaagacagagaagtggagagggatatggtagcacggctgggattgtcacaggaaataacttgccccagtctactttttttcatacacatacagtttgagttcctaattaatcagttgaaaaatccagctcctgaaaatatggctacagaatactgatcattgattgtgattcattttgcttcacataaatggttgcattttcttttcaatgagaataaagtttttctttttcttcctctgtcaacataattccctttgttcttattcagttttcttgttaaatgtttttccacatgtagaattttacaaattgaataatacatgcagaaaaaaagaaaaacaacaacctgtctttttttctttcgtctaggtcatgggagaatgaaaaactagaatcttcatgagcattccatactaaatatttgtattagattatcattatttattactttgctaaacaaccatttttatccatcactttttatgaatctatagtaaaacaaaagtaaacagcctccatgctttcaacaaggagagtctgttgctctaaaaatgtccatttcaccacagtttttcctcatcaccacttgctgaaacttactgcatttgttcatgtttattataaagacttttgccatcctgctcggtatttaagattcatcacaagggtattccccctttagatgttctgactaatgttgatattaaccatgtgacattcacaaagtaattttttcctgaatatatgacagtatatattaggttggtgcaaaagtaattgtgatgtttgccattaccttttaatgccaaaatccatgattttgagccaacctaatatcagaggggtaggtaatgcaattgtaagtgagtgttctttggagtcaggtagatcctgcctcttctcagagcagctgaggggcccgccaaggtctgtggctgtaatcctgagtcatgtggatcaggaacgcctttaagtccatgcctggcagctgaaggcatctgcagtttagattctccttgtaccaattttgcaaatctctgcaatattggaagccatgcacccagctgaatggaagcaggtgaaaacaaggccgcatgaagtcatagcactgtgggcagcagtgcaccagtagtagctctttgtgctcaagaatcaaatgatgactgttggcagggattaaaactggggctgactgagtgctgggctttgatcttgccaaatccactgagacagctgaaatttcatgaaaaggtgacaaggatttcctaaaccaaatgcaaattgatgtttaactttcaactccagctcacacccaaaggctttgcaagtgcttgaaaaaagaatatctggcttgtacatcagaaaatgacctttacaatatattttatttgggctaaaacttgtgctgcagcatcactgaaaaaaattactcttactatttaaatgattatacttttcataaaatttcaatgacagagatgctaagtagagatgatgtttattgaaaggcattcttaaaatttgagaaggatttatcaaatgataaacaacattttgtgataaagactatgcattcccacttatttggtaatgcagccagttacggggtacacaccatttttttctttaactgatgtgataaaaaattgtataaaacttaataaacattttccaacatgaatggatgctgtaattaacctatactcactaaaatcagtgtgtggattagcattgtattgggaaaaatatgtgattatgtgagttataacccagattttgtcatgaaaattagatgcttaaagctaagacatgaccctagtgttctcatcagaaatacgggtagatacaaattagatgattttgaggtaattttcagttaaaagtctctgatacatatcctttttcatatcctctccaatggacccttgtttcattgatgagattattacacgtattaattcgctcccaaagccttttttgtatgtttgttgatcacaagattattttaagtataataattttactagatttaaaaattatttttgaaaaggttgtgtcctctaatgtactccttgaattactcatctgctcttctttatttttgtatctggaattagtgccttgttttcctttttagatgctgtgtgatgtggttactgccccaaatgttcatatttgctaccacttagagtccagccttcttctgttgtctaattatatgctattaagactgtcatattgtgttgttaggtacagaaatttgctttagaaacaaactgaggattgcgtaagtattgacatggcagggtagtgttccatgtgtttcttgggcaagttgggtttcaagcatggatctttgtccacacctctcgcaccttcttggaaatatatacagcaatgtcaccagaaatatcttgcaccttaaggctgtctgtcactgtcagcatcacttggaagctggtcaggaatgcaaaatctcaggctctacccagatctcctgaatcggaattgaactttaacaaatcctctagtgattattatgcaaatgaagtttgaggagcgctgggctgaaacatccttctccttcataacagctttgggtggggtgcttctgaacactctttcccaagatgcagtgttgtcattttccttaatcaactctgtctctgggacacagaacagtcaaacaagattttctgtgttagtctgcttttatgttgctgtaaaggattacgtgagactgggtaatttataaagaaataggttcatttggcttatggttctgcaggttgtacaagaagcatggtgccagcatctgcttttggtgtgggcttcaggctgcttctgttcacagtggaaggcaaaggggagccactgcacagagatcccatggcaagaacagaaacaaaagagcacggaccaggcatgttggctcatgtctataatcccagcagtttgggaggctgaggtggatggatcatttgaggtcaggagtttgagaccagcctgtccaacatggtgaaaccctgtctctactaaaaatacaaaaattagctgggtgtggtggtgggcacctgtaatcccagctacgcaggagactgaggcaggcgaatcgcttgaacttgcgaggcagaggttgcagtgagctgagatagtgccattgcactccagcctgagtgacaagagtgaaattccatctcaaaaacaaaaacaaacaaaatgagcacagggaaggtgccaggctctttttaacaaccaactctcaggggcactctcatgggaactagtagataaataattcattctttactgcaaaaacaccaccaagccattcatgagggatccactcccatgaccaaaacacctctcactaggccccacctccaacactgggaatcaaatttcgacctacaacttggtgaggccaaactatatccaaaccgtaacaccctcttatttggtcagtcactactgctgagaggtgggtggaataattcttcattcagcattaaacaagaaaaaatagatcctctctgaaattgcccatgtattttgctgtgctttaaaaaagacttgtagatctattaccacttgtaaacttttgcatatgtgttcttttaagcatttttcttttttttttttttttttttttttgagacggagtcttgctctgtcgcccaggctggagtgcagtggcgggatctcggctcactgcaagctccgcctcccgggttcacgcagcatttttctttaacactcaatagagtatcttcatggatctaatgagctccaatatttcccatctctccaaccctttttgtgcttgtgttagtccattttacattgctgtaaagaaatacctgacactgggtaagttgtaaaaaaaaaaaaaaagaagttgatttgtctcgcggttctacaggctgcacaagaagcattgccccagcatctgcttggcttctggtgagccctcaggaagcttctacttgtggtgaaaggcaaggtgacatggcctcccacatgacaagagaggaagcaagagcgagaggagggtggtgccaggctctttttaacaaccagctcttgggagcactctctctggaattaatagagctgaaactcactcattaccgtgaagacggcaccaagccatttataaggatccacgcttatgacccaaacacctcccactgggccccactttcaacactgagggtcacacttcaacatgagatttggagaggacagacatccaaactgtatcagtgttcttgtatctgtggagcatcagaatcaccaagatggatttttgacaatttcaggttcatagctcccacctacagcgcttcctggaccgagagaaccccctccgcaggacctggtaactgtgcagagctcttcagggcttccagggagctgccatgtttgggccctgctgacctgactttgcagagtccctgctgcttctttgagggagggaggtgtgatgagaacagtgatgttgatgaatgtaaaagcacttcgcagactgcagctctccgcacatcgccatgggcaccctctgctttcattcttccattctgcgattcttcctgatttctatgctttttctagcacctcactgccctgctgccgacgcttctgagatgaaagttgatctcaatccttgtcattctgataacactccagcttcacatcttgagataattccaaggttccttttatctgacttgcagatggatttgcaaaatatatgtaattcatttatcacctaggcttgacctggttacttctaccatgaggtaactagggctctgaaactggagttactggtgcttcaggtgagctatgcctgtgcccctgtgtaacaccaaggagcggaacctgaccccaacaggcaagttcatgggaggaatatcagcttctctgtgcttcttttcttatggatttttccatggcacatatgggaagtggggatcaaatgaggtcttttctgactgatacagaattgttttcccctacaggtttttgggggcatagttccaagcacactggcaattttgcctcattccttaatgcagaggtatcatgcttttcaaaatacagaaaaacgccactgaattttactcactttgatcctttactatctgggcttttttttttttttaatagactttattttttaaagtaggtttcatttcacagcaaaaccgagtggaaggtacagaggtttcctgtacacccctgatcccacacatgcacagcctcccttgttatcagcatcccccgcaagagtggtacatttgttatcaatgaacctgccttgaaagatcattattacccagtggacatagtgtatattaaggttcactctgggtgtttattagtttccttgaatatttgaaagactcaaggaatttccttctgaaccagttttccagccaaaaggaaactggcattttttaaaaactaggacattttctctccctttatcctcttctcttttttccttcccactcccctggtaggtctgaggtcccttaaagttgaggtgagggtgggaagagacaggtggggacagcagagtcaggtgtggtggaagaagggagggcagaggaccagctcgtgttccatgtaccaggccgagaagcatattcgtgtctgtgggttcgtttgtgggttatagttccgaaagttgatataccacaaatacaactctctggaaattgaacagccagatacgaaatcaatggaaatcaaacccagtctggaattgttaatataatctgtcctcaacccagaaaaagcagtgagtgcttcagatggtacaatgtgtactggcccctggtaacctttgcgttgctggctgtgcccaggatgtttatttcttttgccttacatttataaaatggatctcttggaaacttcagtactggttttctaaacatccttttgtgattctactttgtacttgcctgaattctgaagtgatctttcttcaatagttcattcatagtcagtcatccttgatctatatatatttttttactgattcctaaaattttttggtaagtttaattcatctctcatctagtaatgactttaatagtctgttgcaaatatcggattgcttttccattgctcaaatatcagtgtgcagtacatataaaggcaattcctttgtttaccaaaggacagttcccactaggttaaatctattgctccatctggcccaggggatgggttctgttcacttagtgtttccaaatatagggcactgtgttctagacactcttgcttctagtaaggcaatgttcaaaatatcatctcaacttctagtaagtacttattagtaaaacgcagatgctctctaaccagagctcattttctccaggtcttatctttatgtacatagtatatgtacagaatcccagtgactgcaaattcctggaatatgtattatgtgtgtttatgtctctaatttgctatctctccttgtatgcttaatgttgaactttaaaaccactttttgggaattgttacaaaagctatgtttactacatactatgtgtatatatttataatacataacctaagaatgtgttgctcttgatcctttcggctgggactgttagttatcttggtctctgaatctggtttctgtgtatgtgagtatgtgtttatttgtatattttgtcccatttttggactcacagaaaattaaaaacctgcaaaccgaaactcaccgtgaaaatatttgatataggtgtttttggatgcattttaaaaataataagtattctcattatttaaacactattgtaacacttcagcaagatgcagatttaggcctgaaatcaaccactggaatatatgaagaagaactgatttatggatgttactttatagagttttattatacacagtccccaggactatatagccaatcccagtagggcttaatcaggtaccgttaaatactgggctttaggaccataatcctaaactgcagaatgacatttatctaaagtaattaccttgtgactcaaccacatttcactagtatttgctaatctccctagcatatgggatctgggaattaaaaataagcagatcaaataaattacattttatggtatccttagaggatacaatttgactttggaattgaaaatatgtttgattgcgttactttgttaattttttttacaaggaaaaattaaaagaaagaaattcttctatatgaaaatgttactgtatagctttaaaggcagtaagaataaactcgtagccatgaattaccaaactcaatgcctttttgtctgtttccagctaacacctgtgtcccctggaaggcttgggtagcaaatgtgcccacctaacagtgggaaaaatagcttctgctgggctggcaaaagcagaaagtcgtattttggaaagagtgaagaaaaatgtcaatgctgacctcacactttctcccagtttctgtccccatccccactcccctcctctcacacctgggaggaagtgagaaagttgctacagtttaggattatgaactttggaataagacaaacctgggtttgaaacctggcttgcccactaactggctaagcaaacctggctctgctgtttgacattcctgagcccctatttcttcgcctgtaaaacagggatgagagtgtatacctcaccagtttcagagataagatttataaaaggtcctaggtgaacacttctggctcagagattgacacaaagtgccataaacagctgctcagcccatggaactagcaaaaggtggtctcagtcctgagggtggggactaaaactaggtttcccgccacctccttgaggctgcagcgcattccccagcttctgccagaggaccacatatgcttcttcgtttaaaggattctcttacgatttaaaaggacctgctttatccagagtcctgtcttctttttcattcccattgatcatttgtgttttgctgagatgtttttctatactatattattcgtctttttaaaaacaaaacacagctttcattttcaattccttgttgttttgtattttatcatctttcttcgaagtcctttcagtttactgcattcttctcgcttcttaaattgaatattgagctaatttgtttccagtctttctttttcaaaaaagaaatgcatttaaacctatacacttctttctaataaacaccatagctatgctccacaagatacttttcaaaatctgttattgtttttctttagttagtcatgtaggtacatatatttttcctttggcttctggtacattgggtgttttccacttactgcatttggtcttggattgtcttccagcccacccgcctttcctgtccccattagatgattctctatttcctttatttcttctactggtgtggaagtttatataagttctattgatttttttctactttccatgctcttttaattacaattttaaaatctaccttctttttaacgttctcagtagtctgttttgtttttttttgagacagagtctccctctgtcacccaagctatagctgtagtgcagtggcaccatcttggcacactgcaacctctgcctcttgagttcaagcaattcccctgcctcagcctcccaagtagctgggattatgggcgcccgccaccacgcctggctaatttttgtatttttagtagagacggggtttcaccatgttggccaggctggtcttcaactcatgacctcaggtgatccacccacctcggcctcccaaagtgctgggactacagacgtgagccaccccgaccaggcctcagtagtctttaaaagttaatttaatgtagtcccagctactcgagaggctgaggcaggagaatggcttgaactcgggaggcagagcttgcagtgagccgagatcgcgccactgcactccagcttgggcaacagagcgagactctgtctcaggaaaaaaaaaaaaaaaattaaacatggtaaagttggattctccaaggtagatctagaatctgttattcaccattggttctggtggatgatctgaagtgaagatccgtgtagcacggaccctagccaatcaggagagaggcctgaccatcagctgagtaccctgggccaccacgtggctcacaatggctgaatgcccaccttctacgtgacatcccacatgtgagtgtgacaccctcttagtaccaaagaaaaatcttcacttttttttgtggtgaaggtctgatagtagtacattcttttattcttatatctgaaaacatctttgttttgcttaatttttgactaataacataaatggagatggaatcctatattgacatttattttccttcagaatttttgtaatgattttctagcgacgatcttaactttgtcagtaatctttttctctctgataggttggaatatatttctctggctctgtaatagtctgtagtttcatataggcaagacatgggtttctttcctgcttggcttgtaatctttctagaatccaaggattctggctgtttgtcagttctagaatctccttcagattttagctcttcaaatattgtctcttctttcgtcttcttccaggtctcctattaaagagacattggaatttatcattcttttctctatatctcctaacttttctttcatattgcctacctctacccctctgtgttatgctttgggtgatttcatcaaatcagctttttttcctcactgcttctttttcttctgtgtctactctgaagttttattgaggtttttttttggatctgctttcagaatccaaattaatttattataatttaattatgtacctctgaacttcatatgtattgttgctttcagatgatccaaaaaaacacagacccatcaggtcttttgcttgctttctgtggtgggctgtggtctgtgtgagaattgttcccctttggttatgttgatttcctttgatccctatagcccattccctctacctccctctgtcgttacaaatgtgctaatgtgcatctttctgtgttttgcacaatgcatattgttgttttgtttgcatgtgggtttcaatttacatcatcaagttgtattatacatctttcatcttcatccacactatgtttctggaactcttccatgtcacttgaaaattaaattcctgacacctaactgctgcactgtactctatggtctctatactgcacattttatgtatccccattcccagggatggattctaaaactgaccaacaaccccatcatacatcttgctgtgtccataatttattccttcctatgggttcttgttctcgctgacttcaggagtgaagccgcagaccctcacagtgagtgttacagctcataaaggtagtgtggacccaaaaagtgagtggcagcaagatttattgtgaagagcaaaagaacaaaggtaccacagtgcaaaaggggtcccacgctgggtgctgctgctggctccagtggccagcttttattctcttatttggccctgcccacatcctgctgattggtccattttacagagcactgattggtccattttacagagtgctgattggtccgttttacagagtgctgattggtctgttttacagagtgctgattggtgcgtttttacagagtgctgactggtgcatttacaatcctttagctagacacagagcgctgattggtgcatttacaatcctttagctagatgcaaaagttctccaagtccccaccctacccagaagcccaactgacttcacctcctattgctacagtgaacatccttgaacttgtccctttctgaaggtgtgtaagagtgtctctgggctattcacagaagggtttaactagatactgccggatacctctaggctgtgacggtgttagcctgcactctatttttctcagtgcatgagggttcttctgttcctatatactcaccaatccttgcaaatacctggttttctaatgtaatgcccaactttgtttttactaactctgtttttaggcttgtttccacctgaattgattctcccttagctaagagagccagatagactccatcttggctctttgactggcagccccttcctcaaggacttaacttgtgcaagctgactcccagcacatccaagaatgcaattaactgataagatactgtggcgagctgtatccgcagttcccaggatttcgtctgattgataacgcccaaagccccgagtctatcaccttgtagtagtcttaaagcccttgcacctggaactgtttactttcctgtaatcatttatccttttaactttttgcctacttaacttctgtaaaattgttctaactagacccccctcccctttctaaaccaaagtataaaagaaaatctacccccttcttcagggccgagagaattttgagcgttagccgtctctcgtcgccggctaataaaggactcttaattcatcccaaagtgtggcgttttctctgacttgcctggatacaacataatggaggccccagcaagatattaacgccactgggcgagagccagtctcgctccgggctcccccggaaggacagccggctcggaggggggcgccacctgaggaaacaattttcaggtccccaaagagtgaccgtcttccggaggagagcggatcgactaccgtgtcagtgccctaaaattcaacatctgagtcctcagcttctcaccccggggtcaggtaggtcagatttgactttgttctggttctggtaagagggaagcggcctggtcgccggctaataaaggactcttttttttttttttttaataaagcttttgagtaaataattttatattttcaaatttctccataataagggatggtgaatgaatatataatacataaataaatgaatattcatttatatatcattacatatattttgttcataatatatgaatgaatggatgaattaatttataaatttatgatatataaattcacatagaattttcactaagataccctctcgtgccctttccaatttgcatcttatttttttttttattttattgttattatacttttagggtacatgtgcatgacgtgcatgtttgttacatatgtatactcgtctcaaagtgtggcgttttctctaactcgcctgggtgcaacgctaattgttgatagatgcaaaggtataaaaagatatttcgtgatcttagccctttttatgattattagttaattctaggagttttgaaataatttatttgaaccttacgtaaaaattgcgcatttatatcttttcattgtgctcctatggggcttcctgtcttcttctgttggatttttcaggagttctatatatatattataagtattaaattttgttgattttagatgttgcaggtgtcttctcccattctgccactatcttaacttgtctctgttctcctgtgttaaacagaaactcatggtttctcttaaatgattttttgaattataatttatatacaataaaaggcactgatcattttttagcttaatatgttttgtcattggaagacacccaagttgacaccacctaaaacaagatgtagaacattcagttaactgtccccaaagaagattcccttgctcccataattatcagtgtcccagcctgcacccaacccagatgcaatcctttctgatttgaacacaaattagttttacctgttatgtaaatagaagcaagtggtatgtattcttaggtatctgatttcttcttttaaattataatacttctgaaattcacacatgttgttgctgatttcagaactttgtttcttttctaaacatttttcctattctgttgccagacttttgggctgtttccagggattgactaataggagaaaggctggtatgaatatttttgtagaagcctttttgtgaacatatgttaggatttctcttggggaaatactaagtgggatggcatgtttaactttataaaacttctaaaaggtaccacttaaactcttgccagaaatgtatgatagttcttgttgctccatattctctccaacttttcatcccaacagtattttaaattttaaccaatatagtgtgtatgagatggtattgtattattgtttaaatttgtctttatctaattactaatgatgctgttacatgtgctcattggacgtgatatgtcttcttctgggaagtgacaattcaggtcatttgcctaatttttcttgggttgccttcttactactgagttgcaagagtttttttttttaatatattttgggtatgaatcttttgtcaagtataatattttgtttttaatttgtagcctgcctacctatttattagtgatgcctttcaattagcaaatttaaaaaattgatgaagcctaattcttttatttttctctagttaattttaacataaggagttgagtcggactcaaggtttatttccctccatctatttatctgattcttacaatattatttatgaaacaggctttcatcccctgtcacctaattggctttgcaccttgatttttaaaaagagccgtatatgtgtagatctctattctattcccgtaatctaattgtctgtcttatgccaaaactacactgtcttaattatatatgtttcattcgcgtccgtgtgaagagatcaccaaacaggctttgtgtgagcaataaagctttttaatcacctgggtgcaggtgggctgagtccaaaaagagtcagcgaacagagatggggtgggactgttttataagatttgggtaggtaaaggaaaattacagtcaaaggggggttgttctctggagggccggagtgggggtcacagggtgctcagtgggggagctttttgagccaggatgagccaggagaaggaatttcacaaggtaatgtcatcagttaaggcaaggactggccattttcacttcttttgtggtggaatgtcatcagttaaggcaggaacaggccattttcacttttgtgattcttcagtaacttcaggacatctgagtgtgtatgtgaaggtcacaggggatgcgatggcttagcttgggctcagaggcctgacaatatggttgttctagaaatcaaattgtataattgttttgagatggtagtgattactaatgttttattgcagtcttaaaaatcaggtaccttagccaggtgcaggggcgggcacctgtaatcccagctacttgggaggctgaggcaggagaatcccttgaacccaggaagtggaggttgcagtgagccaagaccctgccattgcacccagcctaggcgacagagcaagtctccgtctcaaaaaaaaaaaaaaaaaaaatcaggcaccttatgtgattctcttttttgacattgtttggcttttgaaatgtattatcttgccctactgcactacctaagacttcttgaacaatgttgaatattgattagaagtgactaaaagtgatgagtgaatacctttgccttgttcctaaccctaaggggaatgtttccaataattcagtgttagatatcatgttatttgtatatcttctgtaaatgccctttatcagattgtgaaagttctcttttattcttagttttttgagtatttctcataaaagaagctgaatgttgtcaaatgctttttctacatgtattgagatagttatataatttttcttctttaatctgttaatgaaatgaattattttgactgatttttaatgttaagccaattttgtattagaaaataaacttgacatggtcatgacctgttattctttttaagtttatagcatccaattgctaatattttaatagatctttgtgtattggaccataagggatatttttcttttttcttaaacttataatgttttttgtaggtttaatatctgggtcgtgcagtctcagaaagtcatttgggaagtgttccctcctcctctattaaaaaaaaaattgtgaaggattggtaattggtattacgccttccttagatattgacatctagtcaggagttttttcttttatgtttttgttttattttatgggaaggcttctgattacaaattccatttctgtaacaggtattaggctatttagatgttctattttttcttgcatcagttgtgataagatgcgtttttaaaggaatctgttttatataagtggctgtatctttaatggcataaagttgtttatgatattcccttatttttaatatctgtagaacctggagagatgctactacttttattactgatatagattcttttcattttttcttgacaatttttctagaagtataccaattttattaaactgtcttaaacaaatttctcacattgttaattttcttttatgtgttttcattttatttctgctgtttttattatttcctttcttatattttagttgtttttcttagcttattaaaagctaaaactttttgttttacaacttattattttcaattcaaatagggaattaaagctatgaatctccctctatgcaccaccttcactgcctttcacattttgatatgttgtgttttcattttcattcaattcaaaatatattttatttttccctgtggtttttctataggtcatcatctgtttagaaacatgttgtttaattttcaaatatttgagtagttttaaagctatttattttcatttatttcaagtttatttatttatttatttgagacagagtcttgctctgtcgcccaggctggagtgcagtggcgccatctcagctcactgcaagctccacctcccgggttcacgccattctcctgcctcagcctcctgagtagctgggactacagtcacccgccaccgcgcccggctaatttttttgtatttttagtagagacggggtttcaatgtgttagccaggatggtctcgatctcctgacctcatgatctgcccgcctcggcctctcaaagtgctgggatcgattttaatattattgttttcagctatcatactttatatgaattttatcattatgatttgctggggaatttttcatgttgcagaatgtgattcatcttagcaagtgtttcatgtgatcttctcaagaaattgtagtgtatagttgttgagtggagtattctattagagataattatgtaaattttgttgacagtattaaaatctcctatgttctttgatttttggtctacttgttttatcagttataatgagaggcatattaaaatcttccatggtgaatgtgagcttttcaaaagcaacattcttcctttagtgctgtcaagttttgtatcatgcattttgaatctctttattaggttcatacacatttaagataattacttcttcttgatggagtgactcttagcattagaatatactcctttttctctctgggttactatttgtcttgaattgtactcggtcagatataaacatagccgtcgagatttatgatgcatagtggttggatagtatgtcagttttcaacattttattttcaaatatctatctctttatgctctaagtgtttcttgtaaaagtcatttatttgaatcttatttttaattagtatgtaagtggtatttcatttatatttaatgtaattatcaatacaattgtatttaagtattttaccagtatttgtttctctttcttatttcctgccttattttgcataatccagcaattaactttttaaatatactttgtgttattttttaggagtttgctagaaattacagtatgtatacttaactatcatagtctaattttcaattatactaaactttaaaaaaatctaagactatcacaattatataattctattctctcattctttgtattcttttgtttcactgtattctataaaacttataacacattgctactggttgtgctgaaatgcatatatatgtacacacaaacacacacacacacacacacacacacacacacccacacacacacatgttgagtatcccttatcccaagtgcttggtaccagaaatgttttagatttcagatcttttaggatttgaatttgcatttgcattatatacttagtagttgaacatccctaatgaaatgtgcaattctccaatgaggatttctttggaatgccatgttggatctcaaaaagcttcagattttgggccaggtgcagtggctcacacctgtaaacccagcactttgggaggctgaggtgggcagatcacctgaggtcaggagtttgagaccagcctggccaacatggcaaaacctcatctctactaaaatgggaatatttcagattttggatatttggactggggatgctcaacctttaatatgtgcttaatatattatgcaacatgtatgtctgtatacaaacaaacacacatgtatattaaatataataagtaggtcctttatttttacctatatgttatactacctatgttttcattctttcctgcagatttgagcttctatcatgtatgatattctttcagcctgcatttctttaagcatttcttggagcacaggttttttggctaaaaaaatctctgagttcttctctagctgaaaatgtctttacttagctttcattttcttaaactgatacatattagatgtccatatcttcaggatacatgtgattttttgaagcattcatatcaagtgtaaagatcaaatcaaggtaattgagatatctatcaccttgaatattcatattttatttatgagaagaatatttgaattgctctcttctatagcttttatttttttatttatactttgactaaatgtagaattcaatgtagaattctatgttgacagttttttttcagcattttgaattttttttccattgtgaggaactcatccatcattcttttcatacttcccctaaatataacatgggctattttttcttgctacttttaagatttcttttcaatttttttttcttttaaggttcacctctgatgtacctaggtgtgattttgaaataactttttaaaatcttatgttgtggtttgctaatcttcttgggtatgtaccttgctgtatttccttaacttaaaaaatattggctattgtctcttaaaatattttttctcctgtatctctcttcttcttctgggattccaattgtttatattgattgatatttttacacaggtcttggatgctttgttttatttttttcatgtttaatttctttgtgttttattttagatattgtctattggcctgcctttgattcttttctcttctatgtccagtctgctattaagcccatcaaatgaattcttcctacctagtatcatacagttacgtcctgatagttccatctgagttttgctttcaccgtttgcttcccatgctgtagttcttcacctgttcacacgtgtcagtattttcctctagagccttcatcgcagctacaaagttcctgagtgataaatcaaacatctgggccatttccatatttgtttctgttaatgagttatcttttaaacatgggccttgttttgttgtttctttgtgtgtcttgtgactttctgttttatgctaaacattgtgtgcagattgaagtaaggaatgtttaccttgcccttgcaggaaggacatgctccttctgtccttctgtcgggctggtgatgtggggctgagtcaatctgacatgtggctgggctgtgctgggctctgttgcagagttaggatcctgagctagattctctttaccttgggttcacatggtgtgaaggtggggtcagcactttgccttcagaagggcttgggatctgagcaccagccagactctttgaatctttgtgctttactgaccagtaaccagctttccaaactgtgggagatctctttctgctttacagcttgcctgccagctctttgagtttctggggcattctctttgctctctagacctgttcttgactttctgtacctggggagatctctttttgcatcaatggactgccctcagcctttgaaggccactgcagggtacttggggaatgcagagatccacctcagttctcctgcactcatcccagcttttggcattcattttgttcactacatttgtccttgcttccttacgttcataccacaaatttttttttctgctgtttgctaattctatgttctatatattatttttatattttaaatttatattttgctctcttgacatctgaaatccagtgtgaacacacaaaaaataagtaggaaaaactccaagtttcataaaccttacctaaagaagtcatttctaatttattcataattgaagctcctgaaaggtctgatacagctctggtacaagggaggtatgtcagtcagggtccaccacaggcacagaaccagtaagttatataggggacagatagaaatctgaagaggaagcgcttgaagtgtttttaggaattggcaattgctgtagcaactatggggcggggctgagagtgtctgaaatccgtagggcaggctgtcagaaagggctggctagaactcccaggcaggagctgatgccgcagttcacaggagcaattttcttctttctcagggaagcttcagttttcctcttaaatcttttcgactgattgaatgagggccacgtaaacgatcaaagacaatctcctttacttaaagtaaattgattacagctgttaaccacacctacacaataaccttcatagcaacacctagataagggtttcatcaaataactggaaactatagcctgacccagttgatacataaaactgtttatcacaagagtaagggtctattccacagtgtggcacagtatgtgttaaagaataaactgtaaggaagaaaataaatggaagcaagaaaatgaaagggctgtgaatcctgacatcatccaacagcaaggcaccctggggccagctctcctgcacagtgggtaggtctgtgtccagttgagggaccctcctgcacccagtgactctcccttcttgtaagccccaaagaaatgctactaggcagggggataaacagcctatctgggattaggcatcagctgttactggagttgtctgggacagccagctgcccagcacctggagatgctgaggcccatgggaatatgtgggccctgctgccaagggaagaggcctcctgctacagccctcgtggtaacagaaaggaggacccccttcttccagttggctcattgtctagcctgccctgagtgagctcctggggcctctctcacatcattctgcccactgcacaaaattgtctgcttatagggcagacattaaaatgctggtattttattctcaaagtgtaagattattatttatttttattttgcctttctacccatctgtatttactaaaacttttactatgtgactatattaattctataataaaaatcaatataacttccagcattttaaataaaaatggagacaagtttatattccccgaggaagaaaatatcattttaatattttgtattttccataagtctccacatataaataccttaagcatctccttgaatgtacagcctggagtgtttctgtgcctgcagtggtctgtgggaaggacaaaaaacaccctaagacctgggagaactcctttttggaggcaatggggtagcttgtataatcagaatattggaaatgattaatccaaattcattgtcttttttcaactagaccagcaatcttaaagaaaaaaaatatatatatttgaaccatactaacacactgtgctttaataaggatagacaagtaactttgctaatatgctctctttctccttgcttcttgggaaactgtcagaatggtataaaatttagataagatgttgtgacttagaaaagaatttgatacaggaagaagggggtggtacacatgcattccccattcattgctaaatgcttcaatcaaacatagtttacgtatcagaaatggaaagaagaagagacaggaaaacatactgattatctacactatcaagaacactagaggcggaggttgcagtgagcggagatcgcgccactgcactcctgcctgggcaatagaatgagagtcagtctcaaaaaaaaaaccaaacaaaaaaacactagatcaagagtggtagttttgtagagaataaattcttatagaaaggaacaaaatatcctaaagactgaattttaatgtttttgaaactagtgtttctgataattttcaaatccatgccatttaacgaggaataggcagagtgcttatgttatgcctgatgctaatctaagtttgggaatgctaacacattagcaaacaaaacatcccagcccttgaccttgtggagctggcattcccgtgaggggagacagatgttgggcctgatgagtaagtccattgtagaatatgttcagagtgataagtagggggaatgagatgaggaggggcatttggggcgtatggataattatagagacagatgtttgtctgtgttccttgaagtggggcttctttggtttagtgcatttactagtggataactaataaaaaacggctgcagtcccttgagccttatttcacttggatgtccattgtcttctagagcaaattgttattatttggtgtggagaggagatgcggaaacgcagagctctggctgtgtcctgagcactaaaccaggcactttcatttccatttccttcgtcttagcaaggaagacaaggaggcattaagcagctagctaccttgcacaaaggccgttcaattaatgggtggtggaagaccgggaggccccaaagccggggccaactatttgctaggcacagtaagttcagtgtctgaaaccaggatacgttttggagcccatgacaattgttttaatttcttttaaaatcagaaggaaaaacatatgtaatccagcctgattgtatttgtctttatacttacagagtcataaaatgtaacactgatttttggggagggaggacccatgagcatcttaacatggccctgcttatgtgtctttaataattctgttgcctacaccccttctgcttgttgtttcttggcatttctccttcgcactgaaaggatgcttgtgcttacggacttgggtcatcttcaacctgtgtccatccccactttcctgtgtctcacagagggccaatgaagccaaggctgttgtcagcaagtatgatgctcagcatttggtagggtgcaacacatatttgttcaatgagtgaatgaatgagcaaatacatgaatacatgagtggaggaacctggcaatagcagtagtggtgggtggggggatatttacttctcttcctagcagactttttttcaaagaaatgtggcatcagcccactgaatgttccagccaatgaaattattttcaaagcattctgtgtcacaaagcccatatggctctgaactaaagggagaattagaaataatctgaaactcagttaaagataagtttgctaaatccagtgcatgatgaattcaaattacttttgcataatgaataatgtgttgggtggtgagtagcggtgtgaaaagctaaattgtgataaacgcaagcttgcaagagtcaatgaatgtctggagagtcttaaactacttaggtgcagttgaaggtcaaaagttcagcaatgtctggcagagtagatcacatgggattctcttgattatgttagtaagattttatgatattactttcagtgtcttgtcttctctggatgatggctggtaagcatgtttcaggccatggcattcttgttatgatgtctccagagagactccccagcatcactagccatctagggtggccgtttctgagcgtcaacagtgccaaagcttctgccctgtctcccaaagcacatgcttacagcaggctaaggagaaaaccctgaaacatgaaatgtaggacaataataatatatgtgaaagaggaaaaaggatgacatcttaatgactgatttagcagagagggtttacagagtttggcttacgtctagacttaaacccttttggtttgagaagtcatgttttagttatctttatgtgccgtttttcatgaagcttctcttggctggggtgtaaagttgatataaaagggtacatgttgttggttcatgcgttcatgctgggggacctgcatgtgtggaaatgacaggagtgacaagagtccaattttacaaaataaactgggactctgaagttttggaggcagacatttgtgattccttctgtgtagttgaaagtgattcacctggcggtattttccctctgttgaagttgaatccccctttccatgtgatgttaaggatgcatgtggacaggcaatatggcccttcttcagataagacactctgggctgctggctgcggttctgggacatcttgaagcccccgaggcactgagtgtgaacatgtgggtgctgatgataattcagaagctatttagaaggtagggacagcaatggaattttgtggaaattaattccaatgtaagtgtgatatgtcacttatccaagggtgttccttatgtgtgacctatttctatgacatcagtggcatgaggcttctctgtgaacatattaatatcttggcattctttggttgagattagcatcagtcagaagctgtggataggctagagtcagctcaaaaacccctgatcacctaccctgacccctgagagtttattacgtagtcacagatggcttctctgttctataagagtagaacttcctcttcatggtcttcttcgagctacagtgtctctaatttccctaaatggctgctcaactgtcaagagatgtaagccctattagccgcattggccattcagctatagacacccagtagccatggtgggtagcagagcaggtctggctggagaggagaagccagtacctcggctactggaaggcagcaggcatacaaaggctgcacttcttggctcctgtcttatgtctttactttgttgtcttcacaacatggccttaaagtattttggaaatggcaccgtgttgggtcatgtgtgtcaggggagcagtatcctcccctccacctctgcccatcccacctgggcctcttcccttccaatctccaggtgctcaccttggaggcacagggagcaactaggtctgtacagcacaccttgctggcacaccagttctccttattgccaagcagcttctcaccctaattaggtattaaaataaacttgcatttgttatggaaagaatgtggctttgtgtgtttttaaggcaagacacaaaattttaggaaattttatttcttgactggcagaataggacacagaagggtctagccttggcaggttcccgtttcacgtgctcattccatttagtcttgaaaacaatcccatgagtagagacagacctagagaaaggaacaaagtggctcaaagtgacctttttgtaggaggcagggttggcaggatccaggcgagatacttggtgctgtcctcagccctaagtccatgccccaaaacaggtcaaaggaaggccagaagtattgatagagaagtagaggaaggaggagggtggtgggaggtcaacgctgagtaaataaagcaacactgcctcttccctctagcttctttgtgtgcatagtcagaacaatttctccaaatttactctgaagattagttactggcatccgtgaagaacttggaagggacaaacgtaccattgttttcatttttgttcctcacaggaaaattcatactctcaaaatcattgttttttcccctgcagtggtctgttttgtagagttccctaaccactttgtttccagtggtaactgtgtactttcctctgacacaagattttaaggaaaagaaactaccaaagatgttttatgttgatttctttttccatatttaggactgctgaccaagcacatttattgtggttatcattaaatgtttgacatttacaaacagcagggcacagagtacgcatctctcagatgggcgggaagcctgagaaccaagggctttcagccgcgtgccttttgcatggctggccttgctcacagctctgctctcactctgcctcccttctcccctgaaatgtgctttttcataggaggctctttctgttttggttttcctgtttttatggctctgcttctaaacatataactatatataaacatataaacatatataaacatataaacatatataaacatataactatatatacacatataactatatataaacatataaacatatatataaacatacaaacatatataaacatataactatatataaacatataaacatatataaacataactatatacacacatataactatatataaacatataaacatatatataaacaaacataaacatataactatatatacacatataactatatataaacatgtaaacatatatataacatataaacatataaacatataactatatataaacatataaacatatataaacatataactataaacaaatagatatattttgttttacaaatttttattttgttttatacatatataaacaaatatatatatatatttcaaaatatagatagtattatcattgatctggtggaactctgagaatttctggattgaagttctcagagttccaccagatcaatgataatactacctgtatttcaaaatataggtagtatttctgctgcttctctatgatgtgttagtagtagatctcttgatctcaggtgacttcaagctgggagacaaactatctttgtttagcaaggacagagaagttaaccagttgcatgactttcagtaaaaaaaatgagagagtcctggacaaaccaagacagttggttgacctgtgagtggtttcagtgtgcaagaacacactggcagttttgacattttgagatgtggtggctctcctagataataaactgtcttccacttctgtgtaagcttttcttagggataactcaccctgcttcagcaaatccgggcgattgtctctatcagccaaattctgcacatgtagcctctgaatctaaaataaaaattgaaataaaaagaaaaatataagatgctttgtttttgcgtctctctctcctagccgttgacttttagtgcatgtcgtgcaggcgacagacgtattgctgccctttctgtctctggtcctttttctagggcaggatccaagtagtttttgtgagcattgcagccagggatcatttcctctttcccttttagggccacaatagtgacctccagcagcactgggtactgaaatacagggctttggctttcccaggctcatacacatagcagagcgtctggtttaaggtctgtataattttgtgtaattatattcaattgctcactcaatctctgatcactttctaatgagctgttattttcagaggtagtagaaaaatcagttcaggaagagatgatgatgtgagagaaataaatagcaaatgactagtgaggagaaattacacagtaaacatgatgctgagctttctctgagtgagtggtgtgtctagggaggtgtattatgaagtacattgctatgaagaacggcctgagactgggtaatttataaagaaaagaggttaattagctcacagttccacatggctagggaggccccaggaaacttaacaatcatggcggaaggggaggcaggcacatcttacatggcctgagagagaaggtgagagagcatgtgagagtctgggaaaaactaacatttataaaaccatcagatctcgtgagaattcactcactatcatgagaaccgcatgggggaaactactgcattgatccagtcacctcccaccagctctatccctcaacacctggggattacagtcaagatgagatttaggtggggacacaaagcctaaccatatcaggaggggtgtgttagttgagcagacacagaaaagcaaaacatttgagcccaagagtggaacccatcccttataaggagagaccacgatgtggggaaagtcagtgaaatggacatatggctaagtttgtttagtgtttgaaaatgtcaccgaagtcactttttaataatgaaaaatatgtggattgaagagtttaaaagagaagtatgcccagatgttattttaaaaattggagtgtatacaaagggcccccaaatctaggctgccttagtatttttgcccctagctttgttttcccttaagtgatgtcaggaactgccagtgttggcctctgcatctccaaaactgaagacagcttagttcactcggtctcgtcattattgtttcatgaaagcatgtcgttgggagatctgggctcagacctaagattgaaacaaaaaaggaaagagaaagataagaaaaccgtctcattttcaaaaaccttcacaaaccccacgttttattaaaatataaaccatttgaagaaaagccagaggaaaatagaggaaatggggtatcactgaatgaagcagaagctaaaggatgatcatataaattgtctcaaatagcaggtcaggaaccagtggcctgtcaccatgaaaacaaagttaggggaaatagacaaatgaaaacaagtgagtttacattattcctaagaactttctgccggtgagaaaataatggaacgacgtgtagtcagcatacacacaggaatctatattttgtaggttatatttcaaaggattcatgtaccctgaaaagaactgttgactgtagggtaagttaacaccagggggtgctgggtgcaggcacattgaatctgaactactgggttgccattttagactgttaccatcatcactgttaccacacctgtagtttaggtcattagataggtgtggaaatgaagcctggctccttatcaatcgaaagcctatgctcttaccaaatacactatgctatttaatattggtaatattagtgaaatttagccgtttcagagttttccttctttccccaaagcatcatttgtcaatgtttgttaacatacgacacttaatgtaatcctcataaacaaagtggacaccctcaagttgttttctgggatttttacataagcatatggtccttgagcaatgatggtttgactttactatgacaatatttggctttaccgtggtgtgaaagtgatatgcattcagtagaaaccatacttcagatttcaaactagatctttacccgggctagcaatatgtggttccatactctcttttgatgctgggcagaggcagcaagctgcaatccccagtcagctacactgtcacgggggcaaacaaccggtactctacaatgcattgtgttgccagctttttttggatgtgattttgcccaactgtaggctaatgtgagtgttctgagcacatttcaagtaggctaggctaagctatgatgttcagtatgttagaggtattaaatgccttttgacttgtgatattttcaacttacaatgagtttctccagacataatcccactgtaagtcgaggagtcgctgtattaacaacgggtagactgaaaacaccgatgtgcaaacctggttcagtacggatggggtggacatcggcatcagggttcttgtgaatattccccgggaacatggggaacgtggtgttgtgaaatctagagctggccaggaatttccggatccttacctccagctttccaccccacacagggggtccccctggagccacctgcctacctgactgcttatcttccagcctctgtctgagcttctctaggtaactcctacatccagggcaactaatttcctggagcaacagaagagccttccttgtattgagacaacatgcatggtctccctgcaaatgctgcctctctgctcctacatcttcacattttagtgtagaaagagcaatcgtgggtgagaatttaagcacaagtgtttagttcaaaagacagaaaattggccacgcatggtggctcaagcctataatcccagcactttgggaggccaaggcgggcggatcacgaggtcaggagatcgagaccatcctggctaacacggtgaaaccccgtctctactaaaaatacaaaaaattagccgggcatggtagttgggcgcctgtagccccagctactcgggaggctgaggcaggagaatggcgtgaactcgggaggcggagcttgcagtgagccgagatcgcgccactgcactccagcctgggagacagagcgagactccatctcaaagaaaaaaaaaaaaaaaaaaaagacagaaaattttaaaagcatcaaaacagccgttacagagagggaaaaaaagttcttaagtatcttagaactgcttcatttcaatagatgttgcaataagctgacttctatatgacttataggtcccgaatcattgatatttatgtttgcaaatttgtgtgttttgtgtaaatgagatcccagaactacaacataaacttctaatgaactctgtttctatacctatgtggatcctgagaggtgctcaaatatgagaggctgtttctcttaacctcctattctgcttaaaatcatttgtctttacttgtacttttttttttttttttttgagacggggtctcgctcttttcgcccgggccagagtgcagtggtgcgatctcagcgcactgcaagctccaccccccgggtttacgctattcttctgcctcagcctccccagtagctgggactacaggcgcccgccaccgcgcccggctaattttttgtatttttagtagagacggggtttcaccgtgttgaccaggatggtctcaatctcctgccctcgtgatcctcccgcctcagcctcccaaaggtctgggattacaggcttgagccaccgtgcccggcctactttaactggagaattcattcttccaaatgtgctcattcatggttttattttattttattgcattggattgtatcattgcatctcctacctgtgcattttaagagtttccacttcaaactttgtttcattatgaggtaaaccttaaaaaataaagcctgttttctggagtgccacagacattttgtcagaagaaaatgtgactgtcctttaatcgggcactgttttatgcacataatacaaatgatttctgcatgcttatcagatctacttgtgggcttataaattcacttcatcctggcatacgtagtgaaggacattcctctgtgccctgtcaagaataatcaagcttttaaaatcaattccagtggtgataaaaataacgaggatggtttgtgaaaagggacaaaaacttggtaaaaataacattgaaggatttacaatatacagagagaaagtgaaccatctctttgaaaataagtgtaaaaaagaaaagtgtatctaatatttttattgatgcataagctatgaagagaactatcaatgtttctgtcttgctctaaatgagatatgactggtgggatcccagatcatttgattatccgtttgcagactgctctgtttatttaaaacataattcactctctcattctatagatggacttactagataggagtctgtgctttataagtgaaattaacttagataatttttttttttttctttttgagatggagtcttgctctgtcgcccaggctggagtgcagtggtgcgatcttggctcactgcaagctccgcctcccaggttcatgccattctcctgcctcagcctgctgagtagctgggactacaggtgcccgccgccatgcccagctaatttttttgtattttttagtagagacggggtttcaccgtgttaaccaggatggtctcgatctcctgacctcgtaatctgcccatctcggcctctagatcattttaatgacaactgataaagagataatcaaatgataacctgtttttctcagtgatagaaatatgtgatggaaagtatctgagactaatgaaagacatggaaactaatttaccgatgatccttggatactagttatggaagtatacttatattatctatgcaaatatacaaggtcttttgaaaaccttttacatgcccaacgccaaatatattaagtgaagctacacaataagatactgtaggatcagtaaacaggtattgctaacgtttgtagcaaaatcctgttgatccacattgttgggtctttcttggtatggtctagtgagatatcagtgcgtgtgtatatatgtatcagtgcattttagttcattttgtgttgctataacataatactggaggctgacaaattaagaagaggtgtttgcttggctcacaattctgatggctggaaagtttaagattgagcatctgcatccagtgagggcctcaggttgcttccactcatgacaaaaagcagaagagaagtgcgcatgtacagggagattacatggtgaaaaaaggaagcagctgggcatggtggctcacgcctgtcatctcaacactttgggaagacgaggtgggcagatcacgaggtcaggagatcgagaccatcttggtctctactaaaaatacaaaaaattagccgggcccggtgttgggcgcctgtagtcccagctacttgggaggctgaggcaggagaatggcatgaacccgggaggcagagcttgcagtgagctgagatcgcaccactgcactccagcctgggggacagagtgagactccgtctaaaaaagaaaaaaagaagcaagagacaaaagccaaataagccagactctttttaacaacatactctctcaggaattaattcccgagagaaggggaatgcacacctgagggagggcattaatctattcatgaagtattttaccccgtaaccagaaaaacttccacttggccccacctcccaacactgccacactggggataaaattttagtatgggttttggcagggacaaaccacatccacaccatagcagtaaatattgatatacagttgacccttcaacaacatgggtttgaaccgtgcaggtccacttacatgtggatatttttcagtaaaacttacactgggtgtgcctgcctctcctgcctccccttccaccttctccacctctcccacctctgccaccccagagacagcaagaccaacccctcctcttcctcagcctactcaatgagaagatgatgaggatggagaactttgtgatgatccacctccatttaatgaatagtgctatgatatggatatttattcccttcaaacctcatgttgagatttgacccctgatgttggaggtggggcctagtaggaggtattgcgtcatgggggtggatccatcataaataggttaatgccatccctcaggggtgagtgagttctcactctgtgagctccctccagagctgatatttaaaaagattctggtacctcccctctctctctctgacttcctctgtctccatgtgatcttcacacagttggttcccctttgccttccaccatgagtggaagctgtctggggttttcaccagatgcctaatcttgaaccttccagctatcagaattgtgagccaaataaaccttttttctttatgaattattacccagacctctgtatactgtcatagcaatacaaaatagactaagacatatagtagtatattttctcttccttacaattttcttaataacgtttttttctctagcttgctttattgtaagaacactgtatttaatacagataacatacaaaatatgtgttaattgcctgtttttgttatcagtaaggcttccagtcaatagcaaactattagtagttaagttttgagggagtcaaaatttatacatatatttttaactgtgtggggactggacactgtggctttgttcaagagtaaactaaatacatagaatctcatcttctgaatattataaacattattagacgtgtctttcctcaaaggtgattattctatatagtgatttggtttggaggtagaaaaagtgcagagaaaatttaagcaaatattaaacatcactttttcttctatacactctatttttcttactgacagaatttttctggaacatttaacagtatcttctaacaggtacctctctcacccaacttgtcctcaagtaatccccctacctcagttgagctgtatatggtggctcacacacctgtaatcccagcactttgggaggccgaggaagggggattacttaaggataagacttcaagaccagtcaggacaacatagcaagaccccatcgctgcaaaaaattaaaaaaaatattagccaagcatggtggtggacacctgtagtgccagctactcagaaggctaaggcaagttgatcacttgggagcagaaatttgaggttatagtgagctatgattgcactaatgaactccagcctgggtgacagaatcagatgctgtgtcttaaaaaacaaacaacaacaaaaaacgttggtttgaaatttgacaaaatgttctgcattcacatttagaataaacgttttatatgaggaagttaatatgtcattttctataattaaatacaatataatgtgggtttaaaatttcattctgattcttattttggcatcattaaatatcattactcgatcttgatatttagaaggtttcagaagccaattactagtgcctcaaaaactcagtactgtggaaatgacatatcattgggttctggtaatgaggaatgactatttttctttggatgttactatcaaaacatttttataggcatctggaaaatatctgcctgattaaagagctgtgttttaaatgctcaagatcacgtgtgcttttttcttccctgtgttccccaagcaaatggaatgccatctggattctagatttggctttctcatgtaatggatgtgagaccctgagctagttacttaacatcatcaggctttctggaaagtgaggataggaatgcctgaatattgaatttaaaatattcaagttaatcatgtataaactataaagatttttgaaatataaaatatgcatcatttcattcactcactcactcattcttttatttgttaattcatccaccatttactgaatgccttctgtgcactaggtactgggcttggtgctacctactggaaaattaataaaacattgtctttaaggggctcacaatgtaatgggggaaatcaccaagaaaataaacaatttcaataccatgtgtcaagtgttaaattccagtacaacatgttggtggttacaaaaacgtaaaaacaaaaatgaaatattatgggagcagagattacacttagtatcctccagaaggttaccaaaatccattttatattttacatatagtttgttctgtcatcttctaagaatacctaaaaataggaattacctctataattttaaaaaataatttagtgcaatacagcataggaggagagtatgtctccctctatgtgagtggataaccgtctctgtaatatatacttttctgagatttgttactcatattctttactcagtactatattcagtacacaatggaattcctgttactgttgactagatgactgtcgaaattggctcatttccccaaaattgtccacaaggtgaaggacttgaggggtccctgaaaggctaggtccacagaagaactttccccatggtactggccaggggaaaacattcctagtcagagacaagtatttccaggatttaaactatctttccatttttgtaagaatgatagctgccctttcccctggatcttgcacctaagtaagacttagcagaagcagtctaattttattgtttgcagttatgttctaaaatgtttttaattcgtttaatccaacaatttgtcgcattaaaaaaaaaaaaaaaaactaacaatcaaaacaaacagccaggcatggtgatgcatgcctgtagtcccagctactggctactaaggacactgaggcaggaggattgtttaagcccaggagtttgaggttgtagtaagcgttatgacatctgtaaatagccactgcattccagcctggacatctagcatgaccctgtcttaaacaatacctctacaaatgacaacaatgacaagcaccctgattcaagatctgggattttttgtttcctcctccgcttggctttgctctgaggaggataagtcacgtaacctgttgggcctcagttttgtcatatgataaatgagaaaatggaactaggtgatctttcatgaaccttttatttttaacagtcttgttttagtgatcctatgactctgtcacagaatgttaaaaaaaataattcagaagaaaaatttacaggttgaaatggatttgagaattgaagcatgaattgctggcaggtgtttgcaatatacttttgggtgcaaacggatgtgttatcttgggaatgaagagtgagaagcatttagatatcacagttgttggctagaagaggaaggattggttaaaaaattaaaggtatatttggttaatgatatatatgtaaaaatcttatttgtttgcaaagagttagacacatctgaattttcttacattatacattgtaatgcaggggccttcttgcagggccttgggatgtgtcctgtacacaaataactgatacctcctgaaaccttgcatcaggggaatcctggtggatttccacattatcaccacaggcctttcaatataaaatgctgatttgaatgacatactgtcattgagttgatctctaaaagttgctggaaattttcagaagaacttgatcctcagatactacatatgccctttccaaggcataaaaggtaagtccagtggtactttcataaaagcactgcttaaatatataaacaaaaacattttgtggagttctacaatctagaaagaaatgtgacttgtgctgtttcttcttttatttttaaaatccaccaatagaaactgtccctaagaggctttgtcctttaatcctagctgattgttaaacggtttgttattaatatcttacaattcagtgcagatggttttgagcagtgatcagatgaacaaagatgcttagtgatggttcaatttccgggttggatttgcatcctaatcttagtcttaaaaaaattagaaagctgtttccacatgagctgtataatgttttacttttttactacaattgctgtaatacttcagtccttaagcatagaaaataatgcccattattatattgggtgaaatgaaagctttttaagtgtaaaacatgtaattgtagtctcaaaactatttatgtggcatcaattatggtgaaattagttcatgaaggtaggtgaaaatacataaacattgtgtatatgctaattcatctagataagaattttcatgtagatttggtcagctgtgttagatttaaatgtagtttcagatctggttcagatggaaagtagatgaagctgccaacctttggcagcagcacacaggtggaatagctgagatagaataggtgattggtgaagaagatagaaacatttctaacacatagaagatttcaggacagtgagtgtggcacattctagatgtttcccacactgcagcaatgggagatatacagatcttcctcagtaaacccctatttctagactacgtgagtttccagttgaatcagatttgagaaatgcagtgtgctaaaggcagctcttcttaactccctctgtgaacccaaggaatctgtctcattcattggaagggtctaggaagggaagagaactctttttttttttgagacgaagtgtcactctgttgcccaagctggagtatagtggtgtgatcttggctcactgcaacctccaatgcccaggttcaagcaattcttctgcctcagcctcctgagtagctgggactacaggcacacgccaccatgcctggctaatttttgtatttttagtagagacggggtttcactatgttggccaggctggtcttgaacccctgacctcatgatccgcccacctcggcctcccaaagtgctgggattacaggtgtgagccaccatgcccagctggaaatagaactcttacaatttttctgagtttatctctttacatcagctgcctccttactgtaaaccaaaaaatacaagtctaagccccccagctgactgaatggacacaccctcttggccaaagggacccaaggaaacctgaaaaggtagttcaggccatgacaggaacagaggccatcagacatgtctcattatacactctgccttttggagtttagacacgactgagcagcattaacattaaaatagagatcctaagatggacagaaagattcttcatagcaataagataccaaattccaacctaactttagtataatatcacataacagataaagaaggaaatcaaaatattttaccccaaaatatctttccttgccatattttggaaatggttctgcaaagctgtcttttgtgggggaaattttgcacctgtaaggaatccctattaacataactagatctttcatcttccaggccctcccaatcctgaagagattaacagagagtctagcaccttttaaaagtctgaatgggaaacatttgctatctattgtctctaagggcagccacctatgagacttcatctacataataagaacctcagtctccacaaccccttatcttaatccagacagtttctttctactgattccaggtctttagataataattggttggaataattgacaattccaaccaattgtcaatcagaaactctttgaatccacctataacctgtgagcaacacccccaaccacttcaagatgtcctgcctttctggactgaaccaatgtatacctcgcatgtattgattgatgtcttatgtttccctaagacgtgtaaaaccaagctgtaacccaaccacctgcagctcatgtactcaggacttcttgaggctatgcctcaggccatggtcattggtatttggctcagaataaacctctttaaatatttcagtttggcttttttcattaacactacactttttaagtttgacctaaaggtttctctgtacatagtgaactgtcatctaactggacgtgtaaagggactgtaatctacactgtaacaagtagctgagtctcagccaatcacagcatcccagtttcagccaatcacttgcatccaactattcaaactgagctcaaataagcctgtaagcagccctgctgtttctgtgcctctcgtcccttttgtctacctcactttcctttttctgtccataaatgttatcccaaccatgtgacagtccctcagttactctgaacatattatggttctggaggctgcccaattctcaaatcattctttgctcaattaaactctgttaaatttgtctaaagtttttcttttaatagctactactactctagagaaatatccacaaagacgtaatgtgtttgttcggaataccttgttgaatggaaagaagggtctgtcctaagggacaattgcaaggattgagacacttggtggcaattttgaggaaaaagcaatttttttttgagatggattcttgctctgtcactcattctggagtgcaatggcgtgatctcggctcactgcagcccctgcctcccaggttccagtgattctcctgcctcagcctcctgggtagctgggattacaggcgcgtgccaccatgcctgagtaatttttgtatttttagtagagacgggattttgccatgttggccaggatggtctcaaacttctgacctcaggtgatccgcccacctccgcctcccaaagtgctaggattacaggcatgagccactgcgcccgactagtaaaatatttttgagtagatggctaaacagcagaaagccctgggaggcaggacggcccagagaaaggatattggttgagctgagtgtcaggcctggggctcggtgttggtgtggatctgggatccagataccaatgactagctgggtgatatcggacatttcctataggtaggactagtattttggtagggttcttttcatttgtaaataacgtcaagaactcaaaataccaagcgtagggcttgatgctccatggatcctccataaagcaagactctttgcttagcttttcattatttcattcatttcagcatttatgtcagtgtgtaaaggatacagcaacctgttgacttagccagcacattttctcagcttagatactggtagttaacagtattatttatctcgtcttgcatgatgtacctctaagaggtttgttcatcaccaccatttcaccacagcccttctccctgttagcttagctggggtttccaaacgtcaatataacagattaaatttctttgttaaatatgaaggtgagtgagctgaagtatgacttgtcccaaaatgtaacaccttatgagacaggcctagaacctaggtcttccataccctttcatgctgcctgagtatctcagtgtggttggcagcctattaaaacacagacataactgattcaactcagggtcacaaatgtacatatcagggaactttgttttatttcgtttggtcatatggatgctgagagaaggtagtgtaaggaccactgcttaccgttctcagctgttctcttcctaagcgcaagtagtgggaccctcacagccctggatgcattgttgtttttttttatctcgaagtaaatgactgaagaatcagcaggagttttccagaatgaaaatgtaataccttggtctgtttggaactcagtcaacaccttaggaatgttctgccaagcttgtttatgttacaaattaaatgtatgtatctttaatatttttgttgttggtattctctcaaaacaagaagataaatgacatttttaatgttttttttgagacagggtcacactgtgttgcccaagctgaagtgccatggtgcaatctcggctcccaggctcaggtgatcctcacgcctcagcctccagagtagctgggacctcgggcgcacaccaccacacccagttaattttttgtatttttggtagagatggggtttcaccatgttgctcaggctggtctcgaactcctgagcttaagtggtttgcccatcttggtctcccaaaggctgggattacaggcatgagccaccgtgcccggccttgttttaccctattttgattcttccatggcttttggaaaatgcactagatttttaattctttgggccactctcagataaaatatcgctgtgtactactattgacatgttaatttgtcttctaacggacaattatatatcccaaagtcatgcctacctaatggtactttaaaaggactaatttgatgatcactgttgaggatgtagaaaggctgtgaccctggcctttcaaacacattctattcaattttgcaaattgagaaggaaagtaagaggagaaagaaaaaaactgctgtaataaaattggaaattgtttcaggaaattgcacgtgctattgagatctttctctgataatttagaaaaggaaatacaaattctattatatattttatattgtacatatatatatttttttttttactggtttattttcagttgaagattaattacatccaggattgtaaattgctcacgggtcattaccagtcacctactgtcttgcagcagagcaggaaatcagatgtgggcgctttaagatgagctggtttagcgttcacttacttaaagatcagtaccaagccgaacccccttgggaggagtcgatggctcatttggccccatggggagggcggtaattaaactctgaaggcagccctgatgttcagctaaaagctggtctttaaatagtaatacactcgccttgtaaagtgctaggccctcgggtggctgttgacacagtgcgaggagctggcgcttttttctataaaagccaaattgaagaaactgttatgaactcatctgcataaagcaatatgattttgcctgagggtgcaggcaatggggagtgattaaccaaccggctctctccccgctcctccgcagctctgctaacatgccacttgtcactaaaaaattggagacaccatatgccaggctgcctctgctgagcgccccttactgatgccacgcgaggaatccctccccaatttggggggctgcgggacactgcgcagtgtctgtctgtagaggaaatgctgcctgcctgccttcgtcttgctccctgcctttctcagcaaggacattccattgttccagggaacgtggcagagacgttctgagtttgcttgaacaatttgaggcacatttgaaggacagtggaagcattgctccagaaacccagtgtccagacatcttgtttcctctcctccctgtgctgaaggctggaagaggtcccctgtggctggttctcatgacctgccttttgattccaccggtgtctttgtacttgtgcaggaaactcaggagggcatgccttcctcctgcaagccttttatttctcctaaaacctactttgcgttctgtctcccgatttttctgtgctccattaattatgcaaacctcttttgattcaatgtgcaaacagtgcattaaggttttaaccttgaggagaatggttttcatgaggcctgacagctgaatcccaggacttggaaaaggagacgactgtgtttggcttttgaagaattagctttcacgtccctccgggtgataggtttgggtgcagagtggcttctgggctgatttgattataagccaccattttgtgtttccctcagtcaccagaattaagatctttctaacagcaggcgtgtaagaagcaagaaaggaaggccgtggtgtgggagtgtggagaaaaatggattctagaaaggttagcaggctgtcttccttgctgctattgtgtctacaccgggggacagtggggtcatgtctgcctctgggctgtcttccccaggatagacagggttggggacagagaggacggtgaggattccccatgaccaaggttgggctgctcttggctctgtcttagttgctctgcttgatgttatgaggggatttggatggggttgacatgggcctcaagaagaaatgcttctcagcccccttgcccccaataactggggggtatcagcctttagaaaggatcctccaggctcccaccccagccccagcccctggagcaaaaccacattctcactaggcctctcctgaaaaggggaagtgtaagacgtgacttcccttagaaagacctgagcttctctttttctatgggttttggggtgaggccagcagtgacttaatcccaataaatattaaatgagacataaatccaactttagcaaatgtcacccacagatttttgctaaatcaaacttatttgtattttatttttttaaatggatgaacttcatctcgaaggaatataaaaaaactgacaaaccaaaggccactgaggtccatgcatggactagggaggaaaaccccatgtatttactgccagatccatgccaggagctgtgcttgggcgaagccatagctggtggcataggtattgtcaccccctactcctcacatggaaactgaggtggctcagagaagtctacatgatttgcctaaggtcaaaaggcagggaagtggctgttatttgaatccagatctgtcagacccaaagcccatgatctgttggccactttgccgtttgctttgggccagagtctgcctgaggccctggcagagatgtcactgactgggcggtggcccttttccagatacatatccccatgacccaaggaaatgctgctcacagctaccctgagtgtgtggacccccagctctcctgcacagcttcctactgaaaatatctccccatagatgccttgtgaatcattttcccaagaaaaggacttctctacaccttaaccctctttaaaaatgcttgtgtcctaggaggggagaatgtacccgctgagtttcatgcaggggtcttgtcagggaagacagaatgagtgcctatgcactgccaggtcctggtaccagatcacatcatttaagtattacgaccaggttactagggattatttggatcttcttttgtggaggagggaacaaaggctcgccaaggctggaaacccaccaaggtttcccactggtagagaaagcccagactggacctgactttctgttcccaaagcccttgacacgtggccactccagtcactggttttctcagtgacagactggctgggctacacacaagggggctaggggctgaagccactttttgaggtgactctttgttctcccctcattcagtaagtgttggaggctggtgctcggagccatagccagaccattgctggtgccagctcaatgcctgcagtgtgctgggatggtgtgcatatttcacacatcatctcacacaattcttacccctgccaagtgtcccaggacacctgttttagagatgaggaaactgaggttcccagaaagtcagtggcaggtgcaaaggtcatgcctctttgtgtgacttctctgtggtctgtctggtttcccatgacatttctggcttttataaactattaaagcacagactgaaagaaaaagtgggactttgcaggtgaggctgtttaacgtgctggaagagtgaatatatgtaaaatttcggatattacagggctgcctatccccagtggaggttgtctgggcagaaatgatttccctgatttgtgaagattaataaatattttgtaggtccttggtcaactcaggctgctgtcacagaataccatcgtctgggtggcttaaacaacagacattgatttctcaattttaggggctggacatccacaatcaaagcaccagtagatgctgtgtctgctgatgtccatgtggctttcagatggtggccttcttactgtgtccttgtatccctacatggcacagagcagaaggacagaacacaagctctcatgtcttttcataagggcactaatctcattcttgagggcttcatcctcatgacctaatcacctctcaaaagtcctacctcctaataccctcacctactggggtttataatttcgacaaatgaattttggagaaacataaacaataggttcctaaattttgaattctggcgcctattctacctttttttttttttggaaacttttaattaaataaaagtgaatacatgacccagttttcttatttggaaaaaagtgacgcaagttcaatttgactatcaaatgcaaattgaaagataattttcatttggaaaggttcaattgataaatatataacaacaataaaaatggctaaagtacatttcctagggttgtcataacacattaacataaactgtgtggcttaaaaaaattattctcacagttccagaggtgggaagttcaaaatcaaggtgtcagcagggtcgagctctttctgaaagctctagaggaggattatttttgcctcttccagtttctggtggccccaggcattcttcagcattccttggcttgtggccgtatcacttgaatctgtgccttcatcttcgcagggggttcttctctatgtctctgtgtggcctctcctcttcttacgaagacactaattattgggtttagggctcaccctaaattcaggatgatttcatctgaaggtccttaactaattacatctgcaaataccctattttcaaataaggtcacattctgaggttccagaggactttcttaattttggggtgacaccgctcaacttagtacagctgctattcatgtgaagtttccgatgtgacagactcttccaagtgatttgcatatactttgcatagactgcctcccataattcctgttctactccgtgaccaaggcttattcctcaatttctagaaccctgcatggtgagttattttcagcccacctgcctgtattatgaagcttctcccctgccctcctgactcctgctgatgctgcaggaaatttcaccagtgcgatggctcacccctcacttccaggtatcctcttggttaaacccaactcacactgactaagagttcaacttggcacttactgtctatggaacaggcattttcaaagttaaaaagttagcttttgaaagaacagtgaaagaagtgttccccttgggtaggtagatgagacaaataatgaacacaaccgagagcagcaatattttatttacaaatatttttaattatgtaaatttatatgaaataaaacttttaaacaggagattatgaataataatagttgtcatttaatactttcgttgcctggggacagtcctaaaattactaaagtaatgcttggcggctaggtgaccagagactcatgagaagtactaatttgatatccctttagaggtaaaggtggaagactgataccaagtagacagggtttggaggcttcctcaagctgggacttagtttcccttgtagatttgggatccctgcccccccattcctttcctccacagactcactgtggctcccccttcccatgaggtatgaataaaggtgtgaagaagggatgtgtgatttccattcaacctgacattctgcttaatgcattcccctagagggtcgcttgtgataggacatgacctaccccagattctggttctgggtcatgaggccaatgctctgtgacctggctgcccatgtcctcttcatcacttagctaaaggccacctggatgccaaatggtggatcccagtggccatcataacatttcttgtccccatccctataattgattgctggaatcagggaaatggcaggacttcctaggactaaaatgtttaggcctttggggtgttggaggtgaatacatcaggttttaaaaatttatggcatttagacacacactgtcagagggaagaggaatcttacttgtctgacctttccagcctatcaaatattttaaatacttaaacatattttgtatgtgagatgtattctgtattcttttttgaaatgagccagatacattttatttaatgcattgattgtttccccttaaaaatgaatcagataaatatctcaaggagcatatattgtcttcagggaaatgccacacagtgtgatcagcaccaccgcagaggcccgggtgaggggccagtattcagaagaggacacctacctggagctctttcctggggtcgtttctaatattgtgacatgatgctggactaggaagacctggagtctggttaatggtgcaaatatttaataactaggattttaagcactttgctccaagccttcatttccttattgacaaaatgagcaccttagcccattttgggttgcaatcataaagttcaaaagactgggtggcttagaaacagcagacaattattcctcactgttttgggggctggaagtctgagatcaggttgtcagcagatctgtcatctggggaagccttgcttcctgcttcccagacagtgccttctctttgactcctcagatggcagagagcagagctgaagaataagctaactcttgcgtcttttctaagggcactaatccaattcttgagggtcccaccctcacgacctcactaccttccaaaggccccacctcctaatacaatcacagtgggagttaggatttcaacatatgaatttttggggagcacaaactttcagtccatagcaatgagcaattagaacaatttgaaaaccattaatctaacttccacaacatttgagagtagatgctgggcatccaaatgtgtttcttgtgacatcgttacccctaaaaatgttctcttattacagtttcaaattcatgttgaataggtcattcccaacgatatgtatagatagcactgaacattcattttttgagattgagtatttattttttgaaacattctatatattttgaataatcttcttctgaaatcagtcagttagagaacatgtaggcagatagtctcaatgaagaagtggatcaaaaatgccatgtgttttcagaaaacaagtttcttttgttaaaactttgagttcctatttctttttctccatgctcttttgtgtattttgcttggttctttctttgctttcagccactgatctatgcaagtgacattctttttgatcatcaggactgcaagttatcccaaaataatgccttttgttttagaggcgttgccacatctaccaggtccaaaacaaatagaaatttaaatttattccaaatacttgtcttctactactttcagtgcaatacattttgctgaatttggttggatttcttccaagtcttcctaaacatcaatatactgaaaaatcattcttccttaagtataatattattactttattaaagttcattttaatacatgtaatgacatcacaacttgtaaaatgttgaccttaggtcttatatatacttacgcacttatatgcatttatgtgtgtgtatagaccacacacacacacaaatatacacatatatgtgatatattaaacattttaaaattcttgactctgagaaaggcctctattcttttaataaggaaataactttcaatttatgaagtaaactaaaccagaataaatggtacagacaactatttatgaagagcattatgtttaggattcttctcttaaaatacttaaatttaagctttgctgtttattctcgtgtgtttcaaatatgtattatctgatgcttactagcacgcactttattttatttgtaaacttactttccacataggtcttgtttcagagaagcatttaaatatagtctgttactaaaggctggcataaaataagtattgaaatagaggcaattgcagaaagttctggactagttatagtaatgtgaatgcttttttattgaaaatttttatgttatctaatatgcagaaaacaaatgaacaaaaataaaaataacaatggcctgtaaaatgacattcattagtattttgatgtataaaaagacttcccctgtatcaagattatattgatatgcaactggattttcttctaacacttttattgttttatttataacatttagttttgtaatatgcacctgtagtcccagctactcagaaggatgaaagcagggtaatcacttgagctcattaactttgagacatgcctgggccacacagcgaaaccccatctttaaaaaaaaaataccccaaacaaaaaacctttaaaagtaatatatatgggattccttttaataaaatattttctctcagttgttagttggttggctcaatatttgttggtggagtaatggcattaaaaacggattgaagttgatcgaagagggatcagggttgcacagaaaggctgggagggatgggggagctcttttagggcattttggcagaaagcaaaggagatgcgggacccagtagcctaagcagcaccccctctcttttgttcatgtttgtttattaccgatctttttctgatttatatttttaaagctcttatatcctaggaagttttgtttgttgcctccttcactaagcttcctacaatgtggaagaattaaggccatatttagtgacattagaacacaggaagcaaataaaacctgcttctcatcctccagagattcacagcgcagtgtgaggaggggcatggagggacgtagatgtgggtaattaacatcgacagagagattacgctgtgtgtgaaaatagaatctctgagtcctgtgggagcggaggggagagaggaattggttctatctgggaaatcaatggaggcttcttagaggaattgttgtttgatctgaacttttgccttcagaatctagacggaccttaattaatgtttagtgaatggattaatgaatagagtgtttttttgctttctgcttttgggttgtgtgtgcgaaggggaggtgagcgggcatcaaatgtaggaggaacggcccagaagcatgacagttgataattagtcattgtgtgttaagagctcattaattctaataaagatattggagatggatcatacgtgaaaataaagcaccccaaatgcataatgcaactcaatagaaacaaactgctaaaggctatcgacactaacattatagtactatgcaagtaaggacaggttttttggccatatttttccatagcatctaggaaaaaatagaaacgtgaaaatatttgtgagtacatgggaaaatgattttatgttaataaagccattaggtaaaacgagacacaccaggaatgccctgggtcttatctgcatatagagactatgctttcatcttaatgaaggtatctggtccatattttcccttttcaaaaatctcaggaattgtctttttttcaattaataacatcataatatcccttctcatcttataagaaacagagatacacaggaccaacaacaaaaaacatccttgctcttgatctgtccctgattataagtgattttagctgtatttcatttcactgattctgtttgcaaacaggctttcacacttgtttttaagaaataaactccttttctcaaataaaatttcactggaaatcccaatttttcttttttttttctttttcttttttttgagatggagtctcgctctgtcgcccaggctggagtgcagtgacacaatctggggtcactgcaagctctgcctcccgggttcacgccattctcctgcctcagcctctccgagtagctgggactacaggcgcctgccaccatgcccggctaattttttgtatttttagtagagacgacggcgttgcaccatggtctcaatctcctgacctcgtgatccgcccgcctcagcctcccaaagtgctgggattaccagcgtgagccaccgcgcccagccatggaaatcccaatttttctaacaaatctcagcgatgctctggtggacccggtgtggacatctggggtctgggccctctcggcctccccaaccacaagcttgtcccatggagacccctaaagcttgtctgtaaaacatgggactcccttaagtaatcactgggctgtggtcagcgaggttccatcctagtcccaagttttgttctatgaaagtctctgtctgggtttcttttcatcctctaaaggacacgtttttctcttcattttacgagttgattttcctttgtgctgtttcatcctctactacttgacctcatgaaggaaagacggaacccagagaactaggtattgcccttcattgtgtctgagaccccgaataataaattagagcagaaatgtatcattgtctttcttctctcctccttcccctcccttgtgctccatgttccccagtctcatcaagcaattctacctgagaggccttaagatctgatttgaacaccacggccttgatgactttattagcaggcggttcaaggaccacactgggaggaaagaaaaacaaaacacaacagaaaattaaaataaagtaaaataataccattgctccagaattcattgtatggcaaacacagaaagcacaatatcaaggcaaattttgatttcatacttaaaagttgctcgcttttagttttgggccaaattctgcttggtgtcaaaatggggaaaccagaattgttttcaaaagatgaaatatttcccaataataatttaaaacttggacatttcacagctttgtgattgttagaggaaagtacttgggggagtggcgcattttggttgaagccaacagctccgggtcctacaggacagcgtgatgggcctgcttagcttcctgctgtgcttggcgtgctgctgtgcacggggttagctttggattcatacagatgctgtcatctctttcaactggaaatgaaggagcactaacaccccatctcttgatcaaacacgtgacctctgagtggagagggcagaagggctctcaggagtgagtgaccgatgggagagaggctatccccaaattatttggctgtcaagcagacctttacccaactgagtggcccctgctctgcctctgtgtcagacaaacactacatccatccctttactcattctcttgctccactgctcactcactcacctaccacttagcatttattgagcgctctctctgagatccagagatgaattccacctgggtcccacttcagggccctccaaaaccacatggaaggaggaggactacttcatataatgcgaaaggtgcttgggaagcgttggtttgttggggctgctgtaaggaagtacagccagtgacagaaatgtattgtcttacagctctggaggctgcaattctgagatcaaggagtcagcagggctggttccctctgaggctgagagagagtcaattccaggtctctcccagcttctgggagtctttggtgtttggtgatttcatctctgccttcatcatctcagggcattctctctgtgtgtctgtctgtgtccaaatttctcctatttataaagacaccaggcatataggattaaggacccgtcctactctactataattttgttttgtttaattacatctgtgacaaccctatttccaaataaggacagaggtactagggattagtacttaagcatgtgagttttttggtgggggtggggaatataattcctataaaaggtagcattctctcccagtaatttcttcttgaggcattagatgtcacaaataaacaatgttagttttctcagagtttagttactcaagagtgctgtccatttgtggacatgtttgcaagaggagaaggcagcaccgatctatgtcataaatcagcctgctgtctgtctgtctctctctcgacctacctcccttcctcaccacatattgaataaattatactgagtgatatgatatttcagtaggcctccaggaactttgttcagtgaaaagagggtttgataagttgttaaacaataaattaatcaaagtgctcaatgctaagggactttcatgggtatctctgtggcccatgagaatgttctggaaagccagggagagaaaaagatgtttctcaagtcatgagctggagtctgagacctgaaatgggagtagaaaatcctctgccttttcatccggaaagtttggaataagttaggtgttttgcagttctaggagcatttattaaggggcatttcctaagtgaggcagtcctgttctggggatgcacaaggaggcaccatgcctctggccttcaaagctgtcacggctggacttgtttttaaaattcgagagctttaaatcaagttcagaaatcattgccaaaattttctgtgtcctctttacgcatcccaaaactgtatttctgtgtcagccgttatattatgtccttacaaaaattaataagaccaaatcttcaccctgaattagattagaatctaccgggaccgggtgcagtggctcacgcctgtaatccctgcactttgggaggccaaggcgggcggatcacgaggtcaggagatcgagaccatcctggctaacatggtgaaaccctgtctctactaaaaataaaaaaataaaaattagccaggcgtggtggtgggcgcctgtagtcccagctactagggaggctgaggcaggagaatggcgtgaacccgggaggcggagcttgcagtgagccgagatggcgccactgcactccagcctgggggacacagcgagactccgtctcaaaaaaaaaaaaaaaaaaagactctaccggtcagctttggttttcaaaatccattggtagagtattggaaaacctttgaatcttagatggtttcacatcacctctgtaatgacctgacctctaaatataaggtcatattctgaggttcttggggttaggacttcaacataggaatttagggggtcacaactcaacccttaacagtgtcccagtcggcatcacaggaaatcagtttccgcttcttctccaaccataaaatcgaacatgctgatgcccactttcattgtttttcgcacatttgctggctgaatgttggacacttacgtttattaaaggcatgaggttcaccattcagagatgtgatgtaaagtaacgtctcaggctcaacactgcactgcagtgggtgtccttgtaggggcttctttatttgccttgagaattggccacagcacttacctccagcttcttgcctataaatacttctcaaccaagtaggtgtttttttctcccaaatcatgatccatgttgaccttgcaaggagacaaagtcctgctttaaatactttcaggtgtggttggacctagacatctctcactatctttgaaccagttggtcaccttgctccatttaggtgtatctgaggtgccgcgtctctctacagtctcacaaccaccaacctttagcatgttatgtatttatctgcctgtcattcccacctgactttgagcttctcaagggcaaggattggctcttatccatcctgtctcctctgcacgtagcacagtgcttgctacatatctgatactcaactaataatgtacattaagaaatgagatgaatatatttttgaaaaatgtgcttgcatatctacagttagttgagtctctacagtaggaatgatgctgataatttattttttaacttcgacaaacactgtgactcttacatcctgattggtaaaggctgaatgaaagttaaggaaactaaggcttattgagatacaatgtggcaggcatttgccaggatctgaacacacgccatcacatttaaaccacaccctaactctgtttgcatttttgtctgacattatggttgaggatataagtctagggaaattatttgctcaagttattatatgttataataaggagaaaatgaacattttgtttttagtgcttattcacatgaagcactgttctaagactttaaatatgtattatcttatttaattctcccctacacctttaagatagagagtgtcattgtatccattttaagaatgaggatacttagacacagggaatgtaagtaaatatgcagatcagatagggagcaggtggccagccagcatgaaaacctagtgacttggtatcaaaggttacagtcttaactgtgaccacctcttggggaaccaagtcagacccaggtatgtctatcagaaaagtccatcctcttgccccaagctggaaccccctatttttcttattcactactagatgataccacgtaagtttagagattacagaggtaatattgggagaaatcattacaaccgcccatgatttgatgtcattctgtactttatttctaaatcagaggataattgataatagattaaattaaaataagtaatatagaagattattttggggtaattaccttacataaaattattgagtaacataatagattactttttaaaaatatatcactctatatcattgccctggatagcaagcaagatacctgctcttcaaatgtaaagaatgtttttcaaggcagagctcaagaaatatgttcataaaaatgaacacttggtgataaatgtcatcatcctgcagagtgaagcaagagttctggggacatgcctgtggagtctccaggtccacatcaaggcggggtacacacatggatcaccccaagtctaccctttgtgcaggaagactcccttcagctaccctggagatgtgcacattttctagtcgaatttcctatttttccctttcttacatacaagaggaagtaaaaccttgacttgcttctgaactgtcacaaatgacatttacttttttccctgtggaaactacttgaaataattaatatccaagaatataatctttatgcaactactttactcctagagaaattccaaggttagaaaatgtcaaaaggaatctgaattgattttgccacctggggtcaaattttctattctagttatgaaagtcaattttcataaaaaaatttcacatactctaacctgggaatatcctaatttcaatgaataaaaaacatatggctgcctgtttaaattttgacttttaatgcagaatggtggtatttagcttttaccttctattttataaaattctgttattccataggaataaagtagatgcagatttatcaagtaaattttaaaatatgtggccattttaaaatgagatcatacttgcagcacatcaggtattagtaacagaagatttatttaaaagaaaatcaaatggatttcctttcagggaaaccacttgaagaagctagaatattgagagtgatgacatgttccaatcacctaaataggttttgaagcttcattttcaaacctagatggaggaaggaagagatagaaaaacagagggttagatggaaggatggatggatggatggatgggtggatggatggatagatgggtgggtgggtgggtggatggatggatggatgaatggatggatggatggatggacagatggatgaatggatggatggatggatggacagatggatggagggttggatggatggatggatggatggacagacaggtggatggatggttggatggatggatggatggatggatgaatggatggatgaatggatggatggatggacagatggatggatggatggctggttggatggatggatggatggatggacggacggatggatggacgatgggtggatggatggatagatgtttggatggggaaatagataggtggattcatttcctttaacaatgcttatatgttggttttgtgcatcagatcttgaattaggaaatcagagaaagaaacaattttcacatatatcctggaatatgcaaaatattttgtacatatatagagcaatgaaaaggaaattattcttacatgcattcacacatgcctggattcatcacacacattggcaggaggtaaggatagttttgattatttttaagccaagacaatgaggtagcgtttattctctttacagtatcctgaaacaatcttaggacctacagaatcccttttcactcagattccctgcttttgctgactaactgcaagtgaaacatttttccattgaacttgtaaagttaattcaattaagtgactttattttaacccacgtctgtccaggcttcggatgactgtgccatccctcactgaggctgtcacggtggtccctggggccctgtgaaatgcccaaaagcacatatgcgcacatgcgcgtgcgtgtgcacacacacacacacacacacacacacacacacacacacacagagccttgtggctgttttgaagcaccacccccgccaaagtcctacccagggccattccatttgcaggtttctctaaccccaagttctctcttctccaggtcaccccatgctctctctcccccaggttaccccaggctctcttgctctttcctttgagtctctgtacttatgtcccctcatcaggatgcccttggccatcttatatcagcagcatgcccccatcacccatgatcttctttccctgcttgctttcttgttccggaccactgagctaaagccctcggcaagaactgtctgaacactacatataaatcatgacctgcatgagacatttctgaccacctttcctttatgtttccctatagctttcattaccgctgcacataccccatgcttgcttatttatgtgttgttttttgcttgccttccatgtgtctagaacattcatgttgtctgctcattcagtgaggcatctcagacacctagacttgaagtgattctgtcacaaaatagttcagggaaatcaatctgcaaggaggaaaaagatggatcttttatttatttttttaacttgacgtcagcaactgtcttatctgatatttattagtatttcagattcattgttctttttttgttttccccagtggtttgaattttaaaggaatttctttgtataaagtattttaagcaccctcttttatataaagtattaaatcataacattgatttaaagccatttaatttgtatgaccttttaagcagccgtgagagcataaaagaagagtgtatcaaagcaaaaagtaagaactcttgagtcttttgaaaatatttactttgaacagattgcagctccttaaatgatgaggctttggaatctgggaggtggtcagaccccagctctgcctacttgaggccacccacatgtcgctggacccactgtgtgtcctccccaagcccagcacctcatcttcaaagtgacacccacaatagacagctgtgcagagcattgagtgggatgctggatgcagaacctgccaaatatcactggttgctgatttatcagtttaattgaatttctgctgcaaaagaaggaaaggaatgggggcaagacctgcattttccatgacaagatttgtgttttgatggcagggaatgtgctgcatgccacccacctgtgatgcaaccactcaggaatggggaccaaacctttttgcccatctctcctccttccttaaggctgagctgagagctctgggttggaatttcctgttggaatctgctctgttcttccttcacccttgccctgagcaagctcactgagcagctgcctctctgagccgggagctgggcccagtggtggaaatactgacgtggtccctgcccatcagtctgcagtgcagaggggaaacacacccaaggctactgtgggaccctggggtgtgctgggtgctggagaaggaccgtgcaggagcttgggcatgtggctataagaaaggacaggtaaacggagacaggggtgaatgaagaatgagacaggtgtggtggctggaacggtgtacccagcagagggaacctgatcccagagggtgcataatgcgcctgagaccggcagcagccttggggagagggaggcagattccaggcaaaaggcaagctgcaggtgccagcaggaactgtaaaccaccatgtcctgcaagccttggtggttttggctctgctggtgttgacgagacgccaagaaggagattgtagctggagagagacaatcacgttttcagtgtaaactcttattctgcctgaggtgtggaaaatagtcgtgggaacgaggctgaccaacaccagaagcagggcactccttgtacatagttcagtcgaggggagtctagggaagcctgaatggatggttggatggatggatggatggatggatggatggatggatggatggttgaatggatggatggatggatggatggatggatggatggacaggcagggctgagagatgttatggcaaagaggcatgtagctttgatggacaccacggatgtggacagagtgaagaaaacagggaggatgttgtgactcccttatcgagcgatggggtgggtggtggaaactgtggctctaggaggggcctgaggaaatgtgggtttagggtggagaaagggtggtttggtattccataggtggattctgaagtgtcctgggatttccaagtgagaggaaaactgtctctatagatgagaaaaaatattttcttagagcattttaatgtcaaatagaacttattttaggttatttgtcattttaaattagccaagcacttgagtctttctatagggtggatatgcaattgctcagaattgtcttatcatgacacagaatgggatagagcatttactttcagtgtaaactcagttcaagacaccacctgttatcagagctcccaaaagacaacttgtagacaaccagtcaactgaagggctgaaaattattttttgtgaatatttaaaaactttttttaacctgtagttttgtttatcaacaaaagtcaaattgagaaaagagagcttatcaaatctgtatgtgacttaaacaataaatggagtttcagttcctgggtaagaaaattattctaaaaagaaaaccaaatcaggaggagtcaatggtgtttctttgtactgagtttgtgtctgtcgtacaatgaccatggaatggtgcacttggtttggacaagtcacttctgggggcagtgtggagctacagcagagagcaactgagatgtgagcccagggcaattgtataaggtgttcagttcttattatttcatcatgttaaggcatctcttgaaataaacagcacccttagagttaaagcaatatatctgtgacatagaaattgtttctccaaagtattgctggggtcaatgggaaataagcaacgacaagcctgttcccataaactttattgcctcctgtaactgactttctaagtaaataaaggttcttagttttgcttttcttgcagaaaggaaagaaagagggatacccgagggatagatagccaagagttatgctaattctctgatattttataataaaagagatttcatctaaaaagaaaaggaggttctgaaggtggttatgtacattcttccaaactcaaagtcacgtctggaacattcttatatggaaagagctaaaaatacttaaaaatttaccttgaacatttctcatccaatcatattatggtccaggcaggtgctgatatgagggacatgatggtgcaatatcctttgacaagcagaagggactgtgagtctctgaggatgggatgcagacctttgatctgctccataccaactatgaaggaggtccatgtgcttttgaaacacattgtaaggatccaagactttgcagttaaggttgctcctaataaacacaagctaatagtgcaaatatgattcctgtgcaaaggtaaaactatttaacggccactaagaaacagcaccctgttttgtaatagtaacatgtaaaaccaatggcagatgcatgccagcgcctcttagcactggagagcacagtgatcactgccttactggagaaacttcccagaggggagtgccatggaatgctttgaggaagaggaggggctaaaaatggaaagcctaggccagaagcagtggcttatgtctgtaattttgggaggctgaggagggcggatcacgaggtcaggagatcgagaccatcctggctaatacagtgaaatcccatctctactaaaaatacaaaaaaattagccgggggtggtggcacgcgcctgtagtcccagctactcaggaggctgaggcaggagaattgattgaacccaggaggcagaggttgcagtgagccgagattgcaccactgcactccagcctgggcgacagagtgagactccatctcaaaaaaaaaaaaaaaaaaaaaaagtggaaagcctggacattgccaaagacaaaatgtgtctttcatcctgtccatgaggaggctctgactgctgctcacctcgctggctgctgctctgtcttttatcctctaggattctgaaagcagagacaatgacttagcaggtgagttactgaggccaactgagcaaaaacaaaggacagatggagtacctggcagtggaggagtagggacgtataaagccatccctcaaggcttgtgaccttaaggaatagaccagttagttagaaagacaagatgcacttgtacaaaatttaccaacagtatgagactatggtgctagcaaatgtcacagacatgacgattgaagtagaagaaattcttggctcaaggaagagcaatatccagtatttactggaaggaatattttaaattagtgctgttctagaaaattcagggcaatggctatgcattattctatttataaaacatttctacacactctatgtataataatgtataacaaaataacaggccagtaattactataatggagtataatatagtatattatgagaactggaggccaagttctcagaggaagccactttattccttaagttaatatgatgaatctcgctttgtgtctcttatgccttatttgagccacacagaggaggaaagaggagaatcccaacacatagtagattcttgaatttcaccattaaatatgggtcaggactgtggctatggctgtgcttatgtcatggagagctttgtgaaattaaatcaatgatgatttatgaagtcatcatcagaacatggtagaaatactatggttttgggcactgaaccaccccagtgttgaaaggtttgctttttggctttgaggtttaaaaaggagctgtgatattttgagacacagagatgatggatggcagccagaccaggttaccttacatggcagaactcctggagatgactagtggcatgattagagcatccgctcctgtttccacagctatgaggcgggtggtcttcagataaaaggagagccgcatacagggtttctgtctcaggatttcacccacggttcttcctccagaggcaagggtgagcttcatgtttcctttgcaccagtagcaatgacagcagaaacaggcactgcaatataattatactggatttattccagggtgtatctgttatttattactgtataacaaactacttcaaaacttagtggcttagaacaatggctatttgtctagttcatgattgtgtgaactggcaatttaggctgagctcagttgggtggttcttctgctgtcagctaggttcagtcatgagtttatgagcagctgcctgtcagagaggtggctcttctcctggggttggttgccagctatgtgttaggaagataaggagaactggatcattgtttcctgttgtccagcaggcaaccctagactacctcacatggtagctcagtaggtttcagagagagagtgtgcagaagcttagactcagtgctggtacacagcaacttctttcacattctgtgggccaatgtgaaatacaaagatgccccatgtggctagagtggagaagaagactatgggacttgataggaggagttgtgaagatcattgtaaaggctatgatacttggagacatggaggattatggctatttttggcatctaccatacatggggtagattttgtctgaaggcagtgtggctggaagcatttaggaagtgagagcttcacctgtatgtccatatagggacactatcaggaataggaaggtcagagaaaaatggagcttaacagagcaaatgccctaaagagacacagaggccagagccacctgcttggaaagatcagagggatggaacagcagggcagggactttaagccacaccaggcagtgcaaatgctgctaactttgcaggggctcaggaacacaggccagggaagcaccttgacctcctggctccaaagctctgagcatcattcttagaaatagctcccctgccagcatattttgtaccactgagaaagtgactcaggatcaaatccagagctctgttttttttttcttaattaactaattgattttgacaaataaaagtgctctgtatttaaattatataacacaatgttttgatatatgtatatactgtgaactgagtgccacaatcaagctaactaatgtattcaggcctctgttgaagtgccctaatggttctcttcaaactgctgcaaaaatctgataagcaaagttcctggccagcccgaagttacctcgagggctctcattatctccctgaatcccaccccccggcctcacctaccatgccatctctcaccccatcctcttttggcagatgtccttgtcttctacacacctgaaaaggggaaggcatccagtttcatattctcattgcagcacctgtgtcagttaaggcttggatggagccctctgagtagccttcacccccttctccctgaataagccaaataaaagtgggtttcatttgagggagtgacatgtccctgaaaggcttggccttgtggtaagtcacaaacaaggcatgaacaatattcccaccttctcctctctgctaagtacttgccctgaaaaaaactaagttctgcaaagtgctcagagggtttaggtgtgaaccacccagctggaggcagagttatagctctgcctctgggggccagctccagctgggaggttgatgggagcctctgacgctgggctccccgagaagcaagatcctagacaagaatttgagtgtaaggaacttctttcagaggcaggcccagaaagtatcctaggaaattggggaacggacatgggaaagaaaagaagtcagtagagagggtgttgtccagcagtttattggtgtgggaaactggggttcagtcccacctggggcccccgagagatttggtacagtacacttcaaatgatcatgtctgagataccaggagcccaccttatctatggctgaggtctgttcatgctctgtcttgtttgctggccaagagaaggttctcagatggaaggccacaggggttttcagtaggagccctcttggctgagactgaaatgagggtacctcaaaacattaagtgaattttctgagaccatatagctgggagctgagtctgtctaattttaaagtccttgttctttaacaggagaaaagagaaaatggtgacaaataagtagtttcttggatccaagacattgagagtggctatttcctccttgcacagaaggcttcttgatggaaaccaaattactctgaaaagttactagttttaatatcttagcaaatcatttgatacattcacggaagtgtttatcagcaatgtataattgttcttctcacttaaagaatgtttgtttcatgacattggagatctgtaacacaaagacccactttgtatgatgaacccccgtggtgtagctgcttacagggccctcacacacactcttttggtccctgaccacatctgttttaacctggttctgactataccactgtccactgctagacagaaaagaggaagacatgcctcattctccaaaaactggaggaatggcatcattttcaagtttagtttttgttgtttccaagtatatttatgtaatgctgtattatatgtatatacttgccatgaattaaatacgtcacaaataaaatccacttttgggactcaacagtatgtaaaaacacaagtagtatgaacagatttatttataaagttatgatgagcctttctgaaatctttctagcatatcactggtgtaaatgtcatgggaattgaaaataatgtatttgaatttcacagtcttctgtgaatggattttttttttttttttttttttgagactgagtctcactctgttgcccaggctggaatgcagtggcatgaccttggctcactgcaacctccacctcccgggttcaagcaattctcctgcctcagtctcctgagtagctgggattataggtgcatgccaccacgcctggctaatttttgtattttttagtagagacagggtttcaccatgttggtcaggcttgtcttgaactcctgacctcatgatccgcccacctcgtcctcccaaaatgctgggattacagctatgagccaccacacctggccctgtgaattttttaatactgcatttcccaaaaagaatttgtctttctctactttttaaaaaaagttttccctgagtctattataaagtcattcttgaccagaaaactcaagcaaaaaaagaatgaattagttgacttgtccagattctatgtttagcagacatgtgtaccaagagtttgtattgattgttaatacatgataacacagaaagcgctgaaaaatcttaactctatgtaaagtgtttatatatgtatataagcacttaagattttatgtaatataactttttctattcaaccttttaaggaatatctaatattttaaattactttatcaagcaaagaaaaaggacaagtttaaaaataaaaacatagaaaaggaaaaaaaagagaattatcctgtggtgttctctcattaacgaaaaataaaggtttcggaaaatctgttaattttccaaattttagatttttatgtgctattagattggaaaatgacagattaaaattttgaaaaatttgttcatgaaaattctaactttaagttgctcatgatctaaattttcttagctctcatgagatctggttgtttaaaataaataaataaataaattttcttaaggacccaactgccactaagattgtttaaatggtagctactggcattttttgttataagccgaatttctttcatcaaatcaagctcacacattcactcaagttcttaagatactgttgaaatgggaaaagtccctttgtccccctctcagggtgtgtgatgggggtgtggctcgtgttttcggtgcctcactgctcaaactttcaggagagggcatacagacaggcaggctgtggtgactccgaccccatggcagcgtctagaggtgaatgtttacagctcctgaggccccagtgtgtgtgtgtgtgtgtgtttgtgtgttactgtgtgctctattggtttagcatgtgcaggtggcttgtgcgtatcagatcaattagactcctgccttatcacaaagacagagggcttttctgtatcccaggatttcttgctttgctgtaccagaagaatcagatcacacctgggcttggagaatgagtgcaaggttttgttgagtggaagaagctctcagcagatgggggagccagaagggagatggagtggtaaggtggttttcccctggagttgggccgctcagccaccagggctctcctccctctgcctccccgaaactctgcggcattcaccggtcaatggcctgctggcctgctggcttctgtcggtgtgctcttaggccggtgcattcctcccgaagtccagccacttgtgtctttttccactgatgtgttcctctcaacatccagctgcttgtgtgcgtgcccgctagagtctcggggtttttataggcacaggatgggggcatggcaggccagggtggtcttgggaattgcaatatttgggcacaaaaacagaaatgtctgccttcacctaggtccgtgggcacaggcctgggagtagagccctagtcagggaccacaacctcctctacccaacacttccctgcccgcttctgtatcactattccttcattaattagaaagtatgcattttttaaaattatgaagtgtctaggtgtctgccagcattactcaataggaaactccaatagaggagtaaagttatttctccaaggtcaacaaaattaataaatacaaagccttcatcaccagagccgtggtgaagagctctttgcactatgtgtaagcgaaacatgaaatcaacaatttatttaccttcagtgtaaattgttcattgaatgtcattatgttgtcgattattgattcctaccgcatgtgacaattacatgtgcttctgccttccctgccctgagtaccaggctgctttcaactctgggcagcaaggtggcaagatagagttgatggagttgcgaatggaaacaggaagatttggcatctgaatctcgaaaactcttgacgaaaattctctttagatacagagatttgataacttcttaaagcgaagtttgttttgctcatgacgatcacacctatcagctgatcaattctgtttccctttcaaggaaaaaaatatgtatcctgcatcagcaaggattcatgaactaaaggactcacagagtagaactctccacttttgaaactgaggagccaaggcccaaagagaaaacgtgacctagatttagtcattatttattgttttaaaggggggacaatcaaattaatgaaggcagttaaaaatacattgcattcttattaaatacattttgtaggatttatgcctgatgatcatgaacatcaaatctgactttcctgttgagcaaaatgaactataatcaagtggaacgaattgctttgctattatcccttgttgtggatttgtgtcagcacatggtaactgagctgaaatgggctttgtttgcttagctcttctcctaaggagaacaacaccatttactctgagtttgtactgggtttctgtctactaactgcttatattggccttactttaataaagatttctatctcactccttaatacggcacatgccaatgggaaacacataccttatgcctagctttgttctatagcagagtttctcaacctcaacccattgacattttgggcaaaataattctttttctcggggagggagtggcgaactgtcctatgcatttttaaatatattttttaaaaagtttaattgacacacaattattgtacctatttatggggcacaacgtaatgttttgaaacgtgtatacgttgtttaatgatcaaatcaggataattagcatatccatcacctcagacatttatcatttctttctggggaacatacaaaatcctctatgacagctattttgagatgtgcgtaccttgttgttgactgtagttgccagactgtgcaacagaacgccagcacttctcctttctcatcgttaactttgtacccattgaccctccactccccatctccctattcctactccttaccccattctattcactatttttataagattgactttagatttcacatatgagtgaaaacgtggtatttgaggggttaatattcagaatacataaggaactcaaacaggtcaacagcaaaaagacagcaaaaaaaattaaaaagaagatatacaaatggacaacaggtatatgaaaacattctcagcatcactaatcatcagataaatgcaaatccaaaccacaatgaggtatcacctcacttcagttagaatggctattatccaaaagacataataagataacaagggttgctgaggatgtggagaaaggaaacccttacacactgtgggtgggaataaaaattagtaaagccattacggaaaaaagtatagcggtttctcaaaaaactaaaagtggacctaccatatgatccagtactttcactcctgagtgtacatccaaaggaaatgtcctgtgtattttaagatgtttagcattatccctggcctccacccactagatgtcagtaccacccaccctctcactcccagttgtgacaacaaagaatgtctccaggcattaccaaatgtcatcagaaggtcaaaaatgaccccggttgagaaacactgttctacatacagtagggattcttgaattattgtaaaacacagaaagagtgcttttaagttgtttgaaattttattttattagaatctatgaaagtatttttaaatttttagcaatacataatatttgtacatacttacagggtacatgtgatatttttaagcaaacaagcaaaggccatttaagctcaattctcatgtgctaactcaaatacaatgatttgcaattccttatatacacactacatcacactacatatattttctatttatttatttatttttagagagagagagtcttgttctgtcacccaggctggagtgcagtggcacaatctcggctcactgcaacctccaccttccaggttcaagcgattctcctgcctcagcctcctgagtagctgggactacaggcacacaccaccatgcccggctaatttttttatttttaatagagatggggtttcaccatgttggccaggctggtctcgaactcctgatctcgtgatctgcccgcctcggcctcccaaagtgctgggattacaggtgtgagccaccgtgcccggccacacactacataacttttcatccattctcacgttagtgtttgtgttttatttcctcctcaagaatctataaaatataaaaatatttaatgcatttaaattgttgacagcaatctttgattttgaaatactttcatgaaaagcatattttctggaagataatagcattgcattgaatcctgctcctcttaactgacttgctataattattgcagagaattattttctcttgaagaaagatggtatttaaagtaaggtataactactgacctgtgtgcctctagaatgagagcaagtaagtataccaccaaaattcaactggaagtttgtagttttatggctcctagaatttattctaggagcaatttattccactattgcaagctaatctacttcacatataatttagggcaaatgaattatgtcattaaggaaacatattcatttagagttgttaaatgccttctaatagatgcaagatctgaaataatataaatatgtgcttatattaagagtcaggggcaacaaattttagagtctagaatgttataagaaggaaggtcatgtgttttatgatttgatttaaactaccctagtgattcaagttacctagaaccaataatcaacagggtattttatatgtgtatggacacacacacacacgcatacacacacacagagagagagagagagtgagagagacagagacttaaagaaattggcccacacaattgtcgagctggcatgtctgtaatctgtagggcaaagcaagaggctggaagctcaagaatgatttctatttttatgttatggtcttgagtcacaatttctcctctgggtgtcttagtctatttgggctgtcacagcaaaaataccataaactgggtggcttgtaaacaatagaaatttcttcctcacactactggaggctgaaaaatccaagaataaggcaccagcacatccagtatctgttgaggacccactccctggttcatagacagcgccttcttgctttatcctcagatggccaaaggggcaaggggtctctctcaggtgtcttttaagagtgcacaataccgttcatgagggctctcaaatccccacctcctaataccattaccttgtgggtaagaatttcaacacaaattttgggcagatacaataattcagaccatagcactgagactttttttcataaggttctcaattgactggattgtagatgttaaccatatctacaaaacaccttcacagcaatacccagattcgtgtttgatgaaataactgggtattattacagcctagccaagctcacacataacactcaccgtcatatatttacacatgcctaggaagagtaaaataaagggctatctggacattttcttgaattaccagattcataaatacagttatgtaccacatagtgacatttcagtcaacatcggactacatgtatgacagtagtcccataagattataataccgcattttattgtaccacttttatgcttggtatatttagaaatgaagtacttaacattatgttccaattacctacaatatttatgcagtaacatgctgtatgggttagtagcttaggagcaataggctacacagtaaagcctaggtgtgtagtaggttatgccatctaggtttgcattaagcacactctgtggtgtttgcatgataatgaaattgcctaatgacatacttatcagaacatatcccactgttaagccatgcacagttgtatcatgatggatggatgttcttcctataactcaatgaagtaaaattttaaggttttaggtggtgtgtgtgtatatatatatacatatatatacatacacacacatacacatatatatacacatatatacatgtatatatgtgtgtgtatgtatatatatgtgtgtgtatgtatatatgtgtgtgtgtatatgtgtgtgtatgtatatatgtgtgtgtgtatatgtgtgtgtacatatatatatataaaatatatattatatatattatatatataatatataatatatatataaaatatatattatatatattatatataatatataatatatataatttatataatatatataatatatataatatatattacataatatatataatatattatatatatattatatatatatatgggcaaactgcattgaaaatatgtgcagatggtctgcgaggctctttgacagactggctgccacatgtcagcagatgactgggcttgtgcctcacccagcaagacaggacgcatctcaggccttcagggtctcttgcaaatggtcagaactcaagggtccattggaatgcacacacagattcctattgaattggaatatcggctattcactctgtgtttaggaatactcagtatcgaggttcactaatacccatcatggaggttctatgtgccctccttggtcccctgtgtccctggacccaaggtgtgcccaccctctgcatgaagcacccatgtctctgtgaaccaagagtctgcagaggccagaaaagcatgggacccagaggttggcatttgggctaaagctcatactcagagccatgtgcagggccaaacaggtgatgaaaaatgagagcactgggctggacccaggctgaactcaggaacaggcagcagcaacaaatttccagtaatgagagtctgccagggacacagcactgtcactttcctcctgccacctcaagagttaagcctagggacagctgcaggtctcagtgcccacagcagcaccccagaactacattccaaagaggggatcagagaggaagcactttggttttttacacagctcctatttatgtgttcttatgacatgcactgtcctgttttcatggttttgttgaagttccaggtagaatgggctaaatgcacattaagactgaaaacagaatgttaaatggcatcatagacatattagaaaaggagggcttagagattacctgagtcaaccttgtgtgaaaactgagaaaaatgagaccctaacaatgttatatggtaggctgcaaaggctggctttgggtcccagaagaaaatatgcgtgtctgtgtgtgtgtgtgtgtgtgtgtgtgtgtgtgttgcttgtgtgtgtgtatagatgtgtgtatgtgggtatatgtgtgtgtgtatatatatatgtatatacagagagagtatataaggtgaatatgtacatttgcatttatatataaatatataaatacacaaatataaatatataaggtatatatatacacacataaggtgtgtgtgtggatgcatatatatgtgtgcatatatatgtatatgcagagagagcgtatatgaggtgaataggtacatttgtatttatatgtaaatatataaggtatatatatatacacataaggtatgtgtgggggtatatatgtgagtgcatatatatgtaacatatgtatatatatacacagagtatataaggtatatatatatatacatatgttagtatgtaaggtatatatatggtgtatatatatgtatatatataatatatgtatatttacagagagtaaggtgaatatgtatatataaatatataaggtatatgtgtgtgtgtgtatatatatatatatatatggtgtgtgtgtgcgcatgtgtgtgtatccggatttgctactgtctaatgaataaacaagatccagatttgaaacacaatagtgtatatgaatgttatcagaaaaagcccatcaaatttctcccacactggggcactgcagagtccttcccttctcgaatgttctccctggcacttgtgtttctctccttcctgacctctgcctagtcgcagatagagatgcattttgacagaaccgggaagagttgttctatttccatggcaacgtcaattcacattctgcaggtacattggccgccactgcctaaatgaaggctcctcaaggctctgtgtgttgccgtgcctggccaaaaataactgggcatgccaccgttcctcacagccccatggagagaggcattaaactgactggatgccaactgtcaactctgttcctgtcttcctgctaaagaggaagaaacaggaactgccagtgttttgggggaggggagccagggaggctgctacattgtttccatggtctgagaaacatcgcatttcctctgttgaatggaacatgaaatacattcttacttgttcaccccaggggcaccagataatttgtatttcagcagaagtattataattacatagtttagagttagaattaattagcatttggggaagtagtgataaaaccaagcagttattaaaaaaattaattttaatagaggtcagtttggagagagtgcttggttttcttttgaaagatttgtgtgtgtgtgtgtgtatggtgggggagataaaagaataaaattattaaatgatcctttaatcagtctgaaatgtgaactaccttatcattagacgctaccactggatgttaaaatccaaattagtggcacacatgcagaacatatttcaaaattagtcaagagttaggtgaatctttgagggttatctatgaaaaaaaaagaaagttttgtagagtcctttaaaaagtatatcatgttcccaagaatgtgggtcataacaaccttcttgacgttaaacatagtcaagaatgatttcatgtattatactagacacatgagatacttcataataattaaatattgtttgaagaataatttttgaaatcagttaacattgcctacgagtgcgctgagtgtgaagctctcctgggagggcttgtgcacccgggaataaagttgaatctttgccctcatgaggcttttactttgttttgagtgaggagtcagaaaagactgcaatttttaagagtatttttaccttcaattggagttttacaacactcctctaagttcttaaaatcaaagaccatcacagttaaattttaatttttttctgaaattgatcaccgttccgtggttgtataaaagactgtccttgttctcagaagataatgttgaaacctttggggagaaagagacatcatgtatgcagtttactctccaattgttcagcagtaacaataagtgttttcattagaatgagagaaagggaaagcagtggagaaaatgaggcaacttgttatcaagtggtgagtggaagtggaaggtatgctacagttactgtactattcgtataactgttccttcgtttatatatttttttcaaaacaataagttaatgtagtctatagctttaggcaaaaactctttttcaaggaaaaggagcagtgtgcaaaagttatttttattttttcttaaatgaattcgcagtctttttgaaaatctggaacgtcaacacttgtaaatgtatacttctttagttttcagattatagtaggaattaccctactaatattctgaaataagaagtagcctttactgatgtaccaatatttttaagcagtgccagtttctaagtaatcttttcttaacttcgcttctgaaaatttgaaaaatgtcctttcgtcacaagctataggctgcattagtttagcttttccttttccttccaagacaacacccttgccgcagtttggggccagaatgatcagctgacccattccacatctttatactctaaatcaaagttgttccctttaaagagctcattggagaggaatatgtgggatttgataagctccgttgatggtttaataattatgaatgtttaacagacattatacatttatcccacatttactagtataagagcgaaaataaggaatgaaagcaaattgttctgcagggtccatttgtgcatgctattatgccccataaagaaaaaaaatctttcataaaggatcgttagttttttcatcttatttacaccattagatgttgctgcagaacattagaatatgcactggtgcaacgtgaatagtctgtctgctatttattgcataatccattttatgcaatgtcaaaaaggaaaacaaccaaaaatacagggtttattttaaattaggagttaagctctgactttctgatgtgctaagttgaagcctggagcattttctcgctaatccagtgtgagtttctaacagtgagccctgttttaagaggaaaaagggtgatgtagtccaattaataagatggccttgttcattttccctgggatgatgaagcattggatggctccctggctcagtgaaaacagggtggaaaaacgttgatccaggaattgtaaattgagcatgcagggctctgcaacagctttcctatacttctttgggaataaggagtagggttcaccatacctgtccagttttctttgcacttgccactgtttctcttaaattgttttgggaggttgctttcattttggcacatttttgacgaaaaatgtgtgccttcaagttcatgcccaggttgtctgtcctgatcacacaaatggccttggaggttccttatgaattctgtatgcaatctgtcactgcattgcttatgtagcagttttgagtgcaaagccttgaaaattaatgaagtgcctttctgttttctgtcccaatctgtgatctggtgcctggagggtattttgactatttttgacttcacttgtttttgttgttgttgttgttgttacatacagtttttttatttttaaattctctctctaatatgttattttgcttttattctgtccattcattcaacaccatgttgacatagtttggatatttgtccctacaaatctcatattgaaatttggcccctaatgttgaaggtggggcatagtggaaggtgtttgggtcatggggaaagattcctcatgtatagcttggtgccgtccctgtgataatgagcgagttctttttctactagtttatgcaagagctggctatttaagagagcctgacacttcctgccatcactcttgctccttctctggttgggtgacccacctgctcccttttcaccttccaccatgatttgaagctccctgaggcactcaccagaagcagatgttggtgccatgcttcttgtacaacctacagaaccataagccaaatcaatcttttctttgtaaattatccagcctcatgtattcccttacagcagcaccaaacagactaagacatatatgcatagttgtgttcttagattttgttgttgttgttcccaagatagattttcctttctttttttcttttctgttctccatgtctcttcattcatattacagatgaggcacaggacctgggctgaagtatgtacggggtaggtaggttatgttctctcctctttctatgcagtcgatgtaagaatcccagcactttgggaggccaaggcgggcggattacccgaggtcgggagttcaagaccagcctgaccaacatggagaaacaccgtctctactaaaaatacaacaaattagcagggcgtggtggcacgtgcctgtaataccagctacacgggaggctgaggtaggagaatcgcttgaatacgggaggcggaggttgcggtgagcagagattgcaccattgcactccagcctgggcaacaagagtgaaactctgtctcaaaaaataaataaataaataaaaataaaaattagtggaggaaatgggcaagcgtcgaagctgagaattttctatggtcccttccctcccctgcagttctgggaatggccactagggacgcagttgtgccgttaatgggtctcgggggaggccttgcccaggtgtgaacgagggaggtcagagcactgttactcttatggcgcataactatacagtactataactttactatgataacttcactgagcaacggtacaaatcgacaaatggacaacagtttctatcattgattaatcaaataatcagaagtcaataatctgctaagaatattctgacctctactggcccttggcaatagatggagacagaacaatgccgcaaacgtgaagacagcctcccactctctcctctcccacttctcctacaggctttgaggatcaccacgtttcgctccttcattcacatgtctctgacattttagagtccagaacatcacaagatacccataatttccaatgacgtgaagtaatagagataagatttagtaggagagtaaacctacctctgtccttgctgttgtatccccagtgtgcagtggggtgacttcccagagtaggtgtgaagtcagtgtttgtggaataacagatatgaaagaaaatagactcagttttgtaagaaagaacaaggttcactcaggataagatgggcaagggaatttcttcttatgtgtaatcgctgaatcatgcataattggaagggaaagatcactgctacgttaatttcctcctgcaaacacacacactctcttcttgcaaaacagtgtaacctatctcccttgcctttctcattggagaaagctttttgcatgcaagtgtttcccccaaaagcaagacctcaaatagaatacttttttttttttttttttttgagacagagtctcactctgtcgcccaggctggagtgcagtggcgcgatctcggctcactgcaagctccagctcccggattcgcgccattctcctgcctcagcctccctagtagctgggactacaggcgcctgccaccacgcccggctaattttttgtatttttaatagagacggggtttcactgggttagccagaatggtctcgatctcctgacctcatgatccacccgcctcggcctcccaaagtgctgggattacaggcgtgagccaccgcgcccggccgagaatactttttgtaggttggtgaaagagtgacttatgtataggcagaggtgcaaagagagtgttttactggaagtgcagggttgtaactttactctataaagaattataaaatttgtagactcatgaatattagaactgaaaacaacattagtgattctagtttcatcttttccatgtttgtagtcaaggaaaccttttctttggagaaatgataaagttaaccacaatcacattcattttgaatatttttgttattaagtaacatatgctaaatttatgacatttgttttcaataagagctgtgacatggatactctaatcaagaaattaatgtaataacttacattaagctgaatttcttgtatttaaaattttatctatatgtgaatatatttttaatgtcactttttatcagccctgttaacttgagggctgtggcaaaattcctatttctttatctataaaataaggatagtatcatatctgttctgctttcctcttttctcaaaagtaactgagaaaatgtgaaagcattttatgaactataaagcaacataccatgaagagaattaaacaaatgaatataattttattattctcccaaataaatccaacctttattattaacacatatgtgaacagtgcaaaaacaagtctgatacattttttaaaggtcaggaattttgtagaatttttaaactataaaagaaacatgacatgattttctcaaacataaatttcttgcttttattctaatacgtaaataagcacaatactgataacctatgggtcagatctggcaggcttccaaattaacccatctggcagaagtcttgtgattcatggcaacatgcggtccctgggtagggtcttatcaggagttctccaattgttggcatactgtttactatgtaacttacagacactgaaaaggatcctgatttgtttcagaatgggaagaaagtctggctgatggtcttgcacatggacactttaacctgtatgttgccatctgtagccaatgattgtaacttctgtaatgtaccctccaatgaaaaaggacagctctggtgtgaggagttctcttccttctaaactttcttatagaggccttccaactcctagctgactctggaacacacccaacttctgttgacttcctgagtcaatcttcacatttagttttcaataaacctttgtcaatcgtcacgtttgatttcgaacaaatgtttatcaaaccattatcaaacctcaacagtcttaattttggtcaacaatactaacattttgagcaacttattatttaaaaattgatgtatattaattcctaaaaggtggacttattacaatgtaacaaccagtcatatctaaaatgccactagaaaattcctcataaaaatgctatctctgttgaattaataaattttcccttcaatttcatagtcttttttttagaagcctagcctatatagtgtttatttctatattggacctggctatactcattagtgattttatagtgctttctttgttatttattttagagtgctttggggggggacaattttagattctttttttatgagatggagtctcgctctgtcaccaggctggagtgcagtggggcgatctcagctgactgcaaacctgtgcctcctgggttcaagtgattctcctgcctcagcctcctgagtagctgggactacagttgtgtgccaccacgcctggctaattttttgtatatttagtagagacggggtttcactgtgttagccaggatgatctccatctcttgaactcgtgatccgcctgcctcggcctcccaaaatgctgggattatagccatgagccacctcacccagcctagattcttttagagaaagatcaaagcatgtgtaataaagtttgctttctgttctagttttgtttggtttcagaatgcatgtataaaatttttataacttcacagagtaggatggcattgtgcttgggcctcgttcctgttttttaatgtgattacatatgagttctttcatagaaattttactagctagtggtcactgtgtgtgaaatgctgcttattgactgggtccatgtctgtgtctggttttcctcatcattctgaacccactgcatattggcatttgccagtggggtgaaagtactgtacaggccttttggaaaaccaggctcaggccccaggctctgagtgagaggaacaatggggagctgtcatcccctcacctcctcccagtgaaaaatagaaaatcaaatctcctttggccacttggcaaggatctagccgttatttctccagtgtaaaagaaaagggtcttggaaaaagaccctttgctaatcaatatacgagtaggaaagattagagaggtttgacatcttgggcattaggattcactgcctgaactccttttgaattctactttgttttattttcttggaatttatggctgcaaatgactgtgctcttggaaactgagggcctgatgaaagttcttcccttgcttgtgtaacaagtgacactcacggactgacatcaacttccaaaaatatgcagaattttagagaaaaaaaccaactgcacaagttgcaattttgtacaaagaggaaacaacaataactttgtgttttaggtattagggagctcatccatgttcaggccattttaccaaatttaaaatttttaataaccaaaattttaccttagaaatgtagcattttgccatcattccttttgtcaaaatgttgtttttctggctggacacaatggctcatgcctgtaatcccagcactttgggaggctaggcaggaggattacttgaggccagaagtttgagaccagcctgggcaacataaagagaccttgtctctataaaaaagtaaaaaaaaaaaaaaaaaaaaaaaaaaatatatatatatatatatatatatatatatatatatatatatatatatatttgccgggtgtggtggtttgcacctgtggtctgagtgactcaagaggctgaggtaggtggttcccttgagcccaggagtttgaggctactgagagcgatgactgcaccgctgcattccagtctggtcgacagggcaagactctatctttaaataataataatgatgataacaacaacagcaatactaattttaaaatgttgtttgtctccatatttaaatgccaaactgtttagttaacatttttaatttgatttcaattaacctatgcttgggatctttttaccattacaatttgcatttgaaatacataatagagttattctaataatccaaaaacagacttttgagatcttttcccttctctttttgatttataaatagcatattgattcccatttaaagtgtgggtgcagtgtggctgtcagcatattccattttagtaatttcattattgatttatttcttttctaaaagttacaaaagcaatggtgatttgctttcgcaaatagaagtgactcagaatggtaaatactcacagttcatggtttcttccctgcctgacagtgtgagtcagaaattaaataaatcagtgttgaaattcctagaatggaatctgctgggacccacactgcgtccatactccatccccttctctacaaccagattaaacatactctctccatgtagggtggctccacttaggaaaataaaagtgactcaactgtacccatttttccacaggtacatttagcaaataccggtgggttttggttacaaaggtccagggattggtgctctaggagagcagttcaggaaaagggtctgtatgcaggagtggaggggcgagggggtacagagaaagctgctctgtgataggctgtccagagggcagctccaacagtctcctgtgaatgtaagttatttttatttatacatttatttttttgagacagagtcttgctgtgctctgtcacccaggctgtagtgcagtggcatgatcactgcaacctccaccttccaggctcaagagatcctcctgcctcagcctcccgagtagctgggactacaggtgcacaacaccgtgcccagctaacttttgtgttttttgtagagaggggtttcaccatgttccccaggctggtctcaaactcctgagctcgagtgatccgcccacctcagcctcctaaagtgcagagattacaggtgtgagtcaccacatccagctgtagatgcaagttatattcacaaatgtaagatggacattagagtacgtgatttgcctgctatagaaatacagcagtgtgtatgtaaagttgtaaatgccgtattttttacccgtaagacaaatagaagagctatatgctttaatgatgcataggactattttctgaaatctgctactggtgttgaatagttgcggctgtttttttaaatttatttttattattattatttttgagatgtattctagctctgccacccaggctggagtacagtgacgtgatctcggctcactgcaacctctgcctccagggtttaagcaattctcctgcctcagcttcccgagtagctgggattacaggtgtgtgccaccatgcctggctaatttttgtatttttagtagagatgggttttcaccatgttggtcaggctggtctctaactcctcaccttgcgatctgcctgcctcggcctcccacagtgctgggattacaggcgtgagccgctgggcctggccaagttgtggctgttattttaacatagaaagtttttttccaatcaaagtgtaacttctctgataatatgctttgtatttgtgatttatgttttagtaatagtagggcaaaatatttttttcctcttttgattaccactagaccaatattttttgtattatatttaaagttgatattttggtaacacaataagataaaatatatctttttccctttataaccaccaatctgatgtttccaatgtaacagttttaaaaacgcttcttcctggatatacctagtgattcctgaattctcttactgcagcctaacgactgttactcgctctttgctttaaataatcttgacacatagtcctcatcacagatccacattttctttggccatatatacaaactcgacagtgtggtgttggaaatgtgaaagggctgctaactctcctgaatctggggtcactggttatcaaataccatttaagcactttatatctgaattaagccgattttgtttgagccacttgatttttccaatgaagcaagaaggagcaaataagtggtaaaaacaaccttggcttgttttacttttcctccgtgaagtcagtgagtccggggctcccactggtatttttcatgttcatcatggacgtcccaggcagtagcacattctgagaaatggcatctaacctttcaaattgaagattttatttgctagaatattcactctttattgcttatctcaaaatcaggtgggatgagtgtcattactgtcccctcgtgcatgggcttcagatcagttgatagctaagcctagccgatgctcattcatctttgagattaacagagtagcttataaaatgcgttacacatttttgaaatgcaagcatgaagtgcgttagtaaaaaagttccttcagtaaatctttaagaatctggaaaaaagcacaagtcagtttaagagtatcatatccgtggttcactttgcagcagtgactttatatcttgttttgtgtgtgtgtggttctttgcatcattttgaacattttcttgaatgaaaatgagtcagatacagctactttgcttgtctcctgtagacacacactttgattaatagagttgttggcgaagtgttaaaagtcaagaatgttgttatcaccacacacagagggactggatatggggagtgtagtgggattttaaatgagaagcactgcatatcacaatcatagagtaactcctcgagtgattttacgtgatgagccgagcttccccaaagagtaatttaattggcatatttgaagctagaagtttctgacagccaccctgtaccttagcaacagcctgttctcttagtaagagtccctgtaaacaggtgggaaaattaaggcactccaaatgtttatcaagtgtaggacattcattatagtatttaccttttagagatatgtctgaaattccataagacagtttaagcaagccaccagctgttgtaaagggactgagaaagctctgactagtagacttcttcttagaatttaccagactttttttttttctcagaatgctgtgaatcataagactttcactaaactttcctattcttatcaaacagcaaataaactggctaaaaataactggaagaaatcttttagcatgtaacaatactcaactacatggaaataactctatcctgttttcctttgtaaaactgcaacaacaaaaaaattgtcattttcaaactgtgctgaatctctggcagtttttgaacccagctgcctgtcacggtttgagtctctgtactgtgtgagtgatgataggctaaatccacttccactgatttttctaactcattctcaaagttgtcttaaggctttcccattatttccaattacctgtgaaaaatgggcaaccaggaggtgggacacagtaccacaaaaccaagtcattgataggctcttaccttccacctggtggtggcctcagtcttcctttgaatcttctgagtaacatagcaccagagaaccatataaacagcccttgatttccagcctcagaggcagacatgagagctggtatgacagtcaactcttactatatcttatctgtatactatacaaataagggaataaatacaaataaaaagatttttttctgataataaagtaatgcatgtttccactggatagtcttaaaactgcaaatagttactgagaaaataaataaaatgcacttgcagtttcacccccagagatccataatcaggtcctctgtattgaaccattcaagggggagtccaggttccattggaacacaggatggatagcggccccagaagttgcacagctcgggtcttaaacagctgttaacatcttgtgtcacgcattatttgagcctttcgcatcgcctatgtagtttttctgttgttcttctttttttattttgctttctaaaacgagtgtcatgccatgctgacaggttaaagcttgttgtatcctgtatattttaatgtaatgcccgctaaccacagtattccacatcgagaattctgttctcagtgacaggtggactgttctcccgagggagggctgaggcaggaggaagtactcagacttagagaaggcatggagaacagggaaggcagggacagctgtgtgccccgtggccatcaccattgctgggacctgattcttgatgccctcctggctgaggagtcggccaacatccctggtacagacttggtgttattgagtgataaacaaatcctcttcctcctctctcctcgccccactcttttcttcctcttttctcttcttttctcctcccctcttctttcctcttctcttctctttcctttccttcaatgttctaagcctcagactgttcatttctagagctggccagatagaacagtgagtcacggtgagatattgtgtcccatggatttgttctaccagaaacgtttatgagccactgttggggagctctggtgctcttttgaaatatccaatagcatctttctgatgaaagcctggaagagaggttccactagtcagtgaactagcagaaatgaccaactacaatgataacccatgaccatcaattcacagtggctgtaaatcagtgccaattcagacctgaattaccaggtcaaatacggttccaagttgcacagtgaagatactatccagccaaaactaaaaccaaaaccaaatcaaacaaatacatgaaaatcagagctagatcttaatctttgtggcttgagaaatccagagaaaataggaccctgggtaagccctgaaattaaagagacgaatgttaatgacttaaagatttgtgttccagatcttcagtgtatttttgtttgagagttcttgtagctacctgaggtaaggtaacccactgaaaatcagcggatgtgcagcgtgaagttggcatctgacagctccttgatagcactgccacctgctcacttgctcattctagctacaacagttggtgggagaaacatgtgctagtcttgttataagtgcatgttaataaagttttctctgataatgcaggaaagctggggacagaggtagctagagtttgtttttcaaagataacatttctagtctggtcagatgcatccataagagggggaataaacagtgtaggctgatactcatctggtactaatatcctcttggtcgaagcatatcaggcggtgagtgaatacagggcaatgctcgaagaagacttgaagcatgggagcctcagctccaaggtcggtggagcgctctttgaatttagccctgcaacccatcagcagtgtggcctttggcagatcactctccaaaccctggtttcttcttctgtaaaagtagcataatagatattcttaatgcgtaacgttgggaagtaggaagtaaagagaacatatgcaagtgactttgtagcagatatttccttaaaggaatgctatggttctaattgtcagcatcactgtcgcaaatgagacgttcttaacctgctgtgtgccgtagagctctctggcaaactcatggagcccatggaactctcctcaggatagttttgttaaataaaaaaaattatacataatattataaaggaaatcatttagcaaattattactaatatatatgttaggcagaattatgactccccaaaaatgcctgtggcttagttgccagacctgtgaatatgttatgtcctatggcaaggggaaattaaaggtggagatagaattaagtttgctactcagctgtccttgacataagaaaattattgtggattatctgggtgagtccaatgtcatgacaagagtccttaaaagtagaaggaagagacgggagaacccgtgtcagagtgatgcaatgggaaactcgatgggccattgctggctttgaagatggaaggagaccatgaaccgaggggtttgggcagcctctagacattggaaaaaataagaaaatagattctccccttgagcctgtagaaagaagacggcctgccaaccccttgcttttagcccagcttgacccattttggatttatggcctacagaactatagataataccttggtattcttttatgtcatcaagtttgtggcgatttgttacagcagcaatagtaaactaatacagttatcaaattagataaaatccatgatgtatgatatgttcttcttgattaatttattaaatgacacactagatttgtgtccatagcaaattttaagaagttattagtgtcaataaaaatgtatagagagctatatctgaaatgtgattttgaaaatattagtaatttttattgatgatgaagtcacagtactaatactactgtggtttgttgcctatattaataattttaaaacatgataaatttcagttagaggttagtgaaaaatagaacaaatgttttcctatacccagcttcagggagcttcctgaattttatgcatagagggtatgcaggccccagattaagagtccctggtttagatatatgaaagaatgagaaaccttctaagttcttcaagatatatacaattcaaaagcaaaattagaaaatcactgcagccggaaagaacattaataatccattagccggcgctgtggctcacgcctataatcccagcactttgggaggccaaggtgggggtggatcacctgaggtcgggagttccggaccagcctgaccaacatggtgaaaccctgtctctactaaaaatacaaaaattagctgggcatggtggtgcatgcctgtaatctcagctactctggaggctgagacaggagaatcgcttgaacccgggaggcggaggttgctgtgagcagagatcgtgccattgcacttcagcctgggcaacaagagcaaaactccatctcaaaacaaaaaataaaagaatacgaagcttaatgcctttaaaaatttattctcatgagaaaagaggcagctcatggatgacctcagtgaaatcagtacattctctgtggagacagtctttatatatcacaatgaataaaagtagggagcataatttttaaaaatggaggactcaagacacagattgaaaaggggagcacaaatataaagctcacaggaataatactaaatataacacacctgggtagaaacgcatcatttcctctagtgtttgggacagaagtaataacaatacttcaaatatgtatttgaagaatatatattttaatatacaaagaggtgaggttgtcacataaaatagaggatgcccagttcaatttgaattcctgataaacaaaacataatatttagtgtgagtatattccaaatattgtgtggagcatacttatcctaaaaattatgcattatgtaactaacatttagattgaaatggtgtcctgtattagctaaatatggtaaccctgctgagaagagactactaattctacctttaggctgtatgaagtaatatttgcagtaatagatattgtttggagtatctctgcaatgaaattctctttgagcttgctctctttaaaaagagaagcctcgtgctgcatacctaccatattgcctctccaagcccactctttccctgtcttcaccctgctctgagccccaggaggctggctgcctcaatgggctcccaggtcatgggcttcctaccaggttccacaatgggaggcatcagcaggagactatagggcagaagagcagtatcgttagagagttgattttgtttcacctgctccttcccattcaggttgctctgaaaccactcctgcccactaaccctccatgcctagggaagatgacagttttgagctgctcttagcccctgggtactgcactggctttgtaaattgcccctttattaatgattgagcttgaaggtgccatctcttcccttctggagctttaatatgctgaagaatatgatgtagatctccaaggtcaagagtaccgtctgcatccatgaagctgtgaattagaaaaagaaaagtaagatttggaaagaaaatagttaagttgacattcaatagtgaggtcttgctggtcacttaatctctcttttaaaacagatatttattcctggaaggtttctggaaaaattaatagaagcaggagtcttaatcagttgaaagacataaagacatagactacagaaataagcagtttattactagaatgtctatgttactcataaaacaagacataaatcctgtatttatgaaatatatgtatttaaagggctttcttcagaaaacttaaaaaacaaaatatttagaaactatttcataaatatttaggaaaaaggcaaaaagaagcaaatcatgtgttgtcctgagacttttttcctgcaatctcccttttctcctcctccctcccagtactgctgaagttttcttcctaaagaagggtactcagccgggcgcagtggctcacgcctgacgcctgtaatctcagcactttgggagaccgaggcaggtggatcgtgaggtcaggagatcgagaccatcctagccaacatggtgaaaccctgtctctactaaaaatacaaaaattagccaggtgtggtggtgggtgtctgtagtcccagctactcaggaggctgaggcaagagaatcacttgaacccaggaggcaaagattgcagtgagccgagatcgcatcactacactccatcctgggtgacagagtgagacactgtctccaaaagaaaaagaaaaagaaaaaaagaagggtgctcagatcttcacctccagcacagacacttggatgacttccttctatgcatctgagaagttttcaaaaaatatttgctaaatttaattgcatttctgcttctttaacccaactgtcttagatatggtttggaaaagagcaagagaaaagtaaagttaaattccctaattatttcttaaactttccccagaaacttaatgggcacgttggatcatagtttgtcccacatagtaaatgagacacatgcgttgctggtgagtgccttcttaaataagaacagagatctttcatctagaggctggcacagattggaaggttctggctgctatcatcctatatgtagtagagttttggtttttttgtttgctttaatctgaatgtctgattgaggtattcaaagagcaagagagaaacctgtgaagagatggactatttgtgtcagaactgtttaatcttgtggctaggatcacttgtattgttgagctagattcctcaatagctgtctagatatttgacatatggtgttttactctattgtggtatatgaccacataaacagataaaatagtagtaatcttttcaatcttttatagtctgcaagtattcatacacttatttcaaagtagtctgtttctagcttaggtaaatttagatgatttcattgaatactgtattaaaaacctgcttcattccagttaatttttttcaggaattattactcatactacaaggcattatttatagctccagctctcttacatgataaagaatgagctgcgtattacattgctataatgagaaattctcttgtgtttaaattaatctcccttcttagcattgagaaattctgtggattctaaaattctatttgagaattgtaagaatgttttattactctcttataatatgtaccatattttttctctcatatatctgtcagtgatgggtatatatatatatatatatatatatatatatatatatacacacccatatatatatatacacccatatatatatatatatatatacacacacccatatatatatacacccatatatatatatctatatatatatatatatatatatatatatgggtatatatatacacacacactatatatatatatatacatagtgcatatatacatattatatatatatacacatactgtatatatattcatgtttacataggtatatgtgaaatacatgtgcttataaatcctgaacaatgccaggcagctgtttttataatcttgctggtttatacagaagtcagtttctaccacctttcttccaatcctagggaagttgtctctaaaacacccatctacagcagaaagggaagcccatgggccagccactgtgtggttttttatacgcattgctttgtttagtcctcacagcagtcttgcagagcaggtgtggcgtattcccatttttagataatcaaactgaggctcactgaaatacagtgagctctttaaggttactcagctcgtaatggtgggtcattgttgccttcatatacaattgacaatagtaattcctcctggcaacaaaatgagatatgtcctgaactctcattgtgaaggaggcactgtgccaaacatttaagcagcccaatgacacagagttattattcccgttttataaatgaggaaaaccgagacacagaaaggttatgacatgtgcagattttgaaacccagatctaatgccaaaatccatactcttaacactttactatgcaacctaccatgtgctagactttgatgagtctgttggattatactcgaaatccagtacttcatatttcataattttagtggtttcaaaatccacgttattttgaccaattccaacatagcagttctcatagctggaaatacaagttagaaatcagcttccatttagtgatgcaaaactctgcaaaggcaaatgtatgcaagctgatctttatgaaaagcaatcccaattaactttattttttaaacaatttatttgtatattgacaaataaatgtatatatatttattgtgtacaacaggatgttttcttatatgtatacattggggaatggctaaattgagctaattaacctatgcattactgaatatacttatttttatgctcagaacacttcaaatttactctaagggcttttcaggaatacaatatgttgttattaattgcagtcaccgtgttgtaggatagatttcttgaacttattctttctgtctgactgaaattttgtcgtctttgaccaacatctccccaactccccacccctgcccccacccctggaaaccaccattctactcactacttctatgaatttaattcttttagatttcacatatgagatcaagcagtgtttgtcatttgtgtctggcttattttacttaacataatgtccttcaagcttagccatgtttcaaatgacagaatttccttttttataaagctgaatattatttacttgtgtaaattttctttattcttctgttgacacttaggttgattctaatttttgtctattgtgaataatgctgcaatgaacatggaggtggagatatctcttcgatacgctgatttaattcacagcctttggatatagatccaacagtggaattactggataatatggtagttctatttttgattttttgaagaacctctatactgtttccaaaaatggctgtaccagtgtaaatttccaccaatagagtactagggttctctttgatacacatcctcaccaatacttattatcttttgtctttttgataacagccatctgataagtgtgaggtgacatctcattgtggttttaatttccattttgctgatgattaatgatgttgagcattttttcatgtatcgattggccttttgaatgtcctattttgagaaatgtctattcaggttctttggccattttttaattaggctatttgtttctttgctattgagctgtttgcattccttatatcttttagatattaatcccttatcagacatatggcttgaaaatatattctcttattccataggttctctttgctgattgtcttcattgctgtgcagaagctttttaagttgatataatcctagttgtctacgtttgttgcctgtgcttttagggtcacatactaaattcattgccaagatcaatattatggagcctttcccctgtatttacttcaagtcttatgtttaagtgtttaatccattttgagttgatttttgtatatggtgtgagataagggtctaatttcattcttctgcatgtggatattgttttcccagaaccatttatttaagattgttctttcctcaatgtgtgttcctggcacctttgttgaaaatctattgactgtaaatgtgtggatttgtttctgggctctttattctgtattctgtgcaactggtctgtgtgtctgtttctatgccagtaccatctgttttggttactgtagctttgtatatattttggaggcaagtagtgtgatgcttccaacttgttcttttgctcaagattgctttggctatttgggggtcttatggggtttcatatacattttatgctaatttttttctatttctttgaaaaatgccattttgatagggagtgcattgaatttgtagatcactttgggtaatatggacatcttaacaacattaattattccaatccataaacatagaatatttttcaatttgtattttcttaaatttcttttaacaatgtcgtagtttttagtgtacagatttttcacttccttggttaaacttattcctagatattttactattttttggcagctgtaaaaaatgagactattttcttgataacttttttggatagttcattgttagagtataaatattctactactttttatgtgttgattttgtattctgtaatttttttgtatttatctattagttctaatagttttatggtggagtatttagaattttctacataaaagatatgtagcctgcaaacagtgacaatttaacttcttttttttccaatttggatgtttttaattcctttctttttcctaatttctccagttaggacttccagagaagtagaacagaaaggacaagagtgggcatagttattttcttcctgatattagaggaaaactttcaatttttcatcattgtgtacaatgttagctttgggtttgtcacatatgccctttattgtattgagcaacattctttctatacctaatttgttgagaattttatcatgaaataattttgaattttctcaaaagccttttctgcatctattgagatgcacgtggttttccccttcattgtggtaatgtggtgcatcccatgtattgatttgcatgtattgaaccattcttccattctagggaccaatcgtactgatcaaggtgaatagcctttgtagtgcgctgttgaatttggtttgctaggatacgggcctgcaattttcttagagtgttcttgtctggctttggtatcagggtaatgctgaccttgttaaatgagttgcaagcttcacctcttagactttttaaaataatttggggaagattaggattagttcttcaatatttcatagaatttatcaatgaagccatcaggtcctggatttttccttgattagagtctttttactattgactcaatcttgttactcatctctgatctattcagattgttatattcatgattcagtcttggtaagttgtatgtgtctagatatttatctgtttttttatgttatccagtttgttggtgtataactgttcatattagctttttataatccttcgtatttctgttgtatcaggtgtaatgtttctccttttatttctgattttgtcttctttttttcttagtctagctaacgatttgttggttctatttttgaaaaaaaaaaacccaactttagttttgttgatcttttctattgtttttctagttctattttatttgtgtttgtactgacctttattatttcctcccttctaccaattatgggcttagtttgttctcctttttcttgttccttgaagtgtaactttaggttatttgaaatcatcttttttttttaatttaaaagtttttttgttaaaaacttctttattagaactacttttgctacatcctataagttttggcacactgtctctgttttcattagtctcaatgatattttagtacttaaaatttagacgtaaaaaatgacctattaatttcttctttgacccattgatcattcaggaacatgtttaatttccatgtatgtgtgaatcttccaaaatttctcctgttattgatttctagtttcataccattgtggttggaaaagatacctgatgtgatttcaatctccctagatttgttaagacttatggcctttcagtctatgcatgtccttaaatctgaagtgactgtcttacaagcagcacatagttgggtcatgttgtgttctttttaaatccacttatccactctttgtctttttgttgtaaaatttaatccatttacattcaaggtaattgtaaataggtaaggacttattagtgtcactttgttactggctttctggttgttttgtagatcctttgtttctttcttcctctcttgctgtcttcctttgtgattaggtgattttgtttagtggtgtgctttgatcctttactttttatctttgtgtgtctactataggtttttgctttatgattaccatgaggattacataggtggcttatatttataacaggctattttaagctactaatgacataactttaattgcatacaaaggctacactttcacttcgcccaacagtttatatatatatgtatatatatgtatatatttttttttttttttttgagatggagttttgctcttgttgcccaagctggagtgcaatggcacgatcttgactcactgcaacctttgcctctcgggttcaagtgattctcctgcctcagcttcccgagtagctgggattacaggcacgtgccaccatgcccagctaattttttgtatttttagtagaaacagggtttcaccatgttagccaggctggtctcgaactcctgacctcaggggatccacctgcctcggcctcctaaagtgctgggattacaggtgtgagccaccatgcccagccagttttctatttttgatgtcacaatttggatcttttaatattgcatatttcttaacaaattgttgtagctaatattatttttaatggttttgtctttgaaccttcatactaaagatataagcaatttacatactaccattacagtattagagtatacttaatttgaccatttacttacttagactgagttttaactttcatatattttcgtgttgtttattaatgttctttcagcctgtagagctccctttagtgtttcttgtaaaaggggtctgctggtgatgaactacttcagctttatgttttcctgggacaatttttattcttcctttatttctcctaataataagctaatatttaaaaatgtaaaattttgacattaaaaatataagtgttggcaagagtaaaagtatagagattttgtatacaattaaagttatgtccttttctgaaggacaggtttgttgaattggcagttttttctttcagcattctgcatgtatcatcccacctcctcctggtttgtaaggtttcttctgaggaatctgctgctagctttattggaacccctttatttttgattcacttattttctcttgctgttttcaggctcctctctttgtctttgatttttgatagtttgattatagcatgtcttggtgtagtcttgcttgcattgaatctgattgaaaattttgacttttctgtacctgtatatttatacctttccctagatttggaaagttttatactattagttttttaagtaagtgttctacctcttagtcttcctcttctttgcctcaaactcctgtaatgcaaagatttgctttcttgaattggtcatataattccatgtatactttcttcaaattttctcattctttctttttttctgttctaattatataatttcttctttaagttcacagattctttcttctgccttatcaggtctactgttgatgacctttattgcatttttctgctcctcgattgtattttctagctccagaatttgcttttaaaaaaaaatgtcaatctcactgctaaatttctaatattgatcatttattgtttcctgatctcagtgaattgtttctctgtattttttgaagagttctgaggtttcttaaaaattttttgaattatttgtgagaaagatcataaatttctagttcctttagagttttattttatttctttggtcttggaatctgctctgggagtgtggtgggaagtcagcctgttctcaattagttcttttttcttatttttatataactggctaccaatgacctatattcaaatagaaagcaagccaatttcttaatttaagtggaacttatcctcattatctataatctatacctaataacacatgcattataaagtagaatttatcaaaggctctgaagcactagaataggattttttttttctaaagcaatggaaaaatcacttgatttatttgaaagatatttattggttacttattatactctggtcattattctaggtgtcttagatatttgagtgaacataacagacaaaagttttcctttatgggatttctgttgtgggaagaagggtactacatcaaacctaataaatatgtaaattacatagtatgatcaaatgttatgtgtagcatgtgtgaaagaaatgagacccccgggaaggggggttgggagtgatggcataggggttggcaatagtcagtgggggcaaaatgcttcaaacagggcttgctgagaaagtggcatccgaggaaatgcttaaaggaagggaagttgctggtgaaatgtatttagaggaagagcttttcaggcagagagagaagctaggcaaaggtcttagggcaggagtgtgactagcatgttgcagaaacagcacaaaggccagtgtgcctgggttgaatgaattgggtgtgggggtgtttatagaaggagggtaggtaggacagagaggaaatgggagacaggttacctggggtattgcagcccttggaatacccttgaatggtacagggtacttttgcatggatttgaacagagaatctaatttctgttttagcaactgcagcagttgctgaactgagaaaagacagaggtgactggagggtgggggtggcgtgcaacactagaaagaggcaggcctgcaagggaaaattgccagagtcccagcaatgcttgacaataagagaatcgtggcaaaaaggttaggcagaagcaatcactctctggtcatattttgcaggtagaataagtaggatttgttgacaatgtgaacaggagatatgagataaaaaaagagagcaattaccaataacctcccagaattttgccttattacctgtcaaagagaaaaatagatttttcactagaaagcatttatttttaaaaaagaataagagaacacatttgaagtgttcgtaattaaattaattttagactctaaaattgcactttcttttatgatatcgtaagacaaaatactttgaaattttacaaacatcttaaaacacgggggcagagactcacagattttataagctggtgaagttttatgtttgaattcctcatgtgcccaagtcacgtaaaagaataatggagctcatccatgtcatctgtagtttaaaaagtgaccttaaatctgttttaattaattattttgccaaagtttggcaattttagagaaagttgaagaatgatttttacactaatagaagtcagcaaaaatccccagtgacaaggaatccttgtgtgaatagagaatgctggtgtttatactgacacattttcatgtccatgagacagaaaccttgcaggacagtgggagagaatgtggggataaaaactaagcaaagaaagcacattaacaattggtcctcatcctaccaagtgccagaagctcctgcctgcactgccaaatggctctagacaacctctttgtgacgtcagggtgggggtactccagccagacctctctcaaatcttttctcaagaatgaggtggaagttaaacaaagacttcccaaccctaacctccttcctctcacatacccttacctgattcctgcatggagaggaggatggtatgtgatccatcagccacacagtgggaaagtaatatttcaacatccatgtaatgaaaatatactgtgtgaacctacatagtaagtaaaagaaattaaaatgtctagaatccaattatagattccatttttttaaaaaaatactgtatttattgtgtataacactgtccttagcaaatcacatagacctactgatatggtttggttctgtccccacccaaatctcattttgcattttatctcccataattcccacgtgtcatgggaggggcccggcaggaggtaattgaatcatgggggtgggtctttcctgggctgttctcatgataatgaataagtctcaggaaatctgatggttttataaaggggagttcccctgcacacgcactctcttgcctgctgccatgtaggacatgattctgcttctcatccaccttctgccatgattgtgtggcctccctagccatgtggaacagtgagtcagttaaacctcttgcctttataaattacccagtctctgatatgtctttattagcagcataagagcagactaacacacctacaaaatcttacgttgtatcctaactgaataatatatctttgatttttatttccatttccaaaatttaggggatggaagatgtcttagggttctctggagaaacagaaccaatggtacttatttttttttttttttttttttttttttgagacggagtctcgccctgtcgcccaggctggagtgcagtggcgggatctcggctcactgcaagctccgcctcccgggttcacgccattctcctgcctcagcctcccgagtagctgggactacaggcgcctgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcccttatttatatatagaagatatttattttaaggaattggccaacgtgattacggaggctgataaatccagaatctgcagggtgggccaagaggttggagaccttgagaagagcaaatgttgcagtttaagttcaaagtcagcaggggacccaggaaggaactgatgttccagtttgaaggccatcagcagaagaattattttgcttgagggagctcagtttcctgttccatttaggcctttaactgattggatgaggtcacccgcattagggagggcagtctgctttgctcagagtccactgactaaaatatcaatctcatccaaacacaccctcacagaaacacccagaataatgcttgactaaatgcctgggccccctgtggcctagctgatttgacatcaaattaaccatcacaaaattttcttttctttatgcaaattttatagcattacttttgtgttgtggttttttagaagcatagacctagagaatagtgcccatgacctctgactatcctattatacatgaggattgcatagtatggtagaatctcctataatattctttccacgtggctgcagaatctctgtgaattctctttgaaatcgctgtgaactctcttgaactcatttttgttggcttttggtggggaaataactagaatttaaattgtgtccagtaaaggtgattctggaaatgaagccaaggaaaaataaaccatttgcttaatctttcaaggggcacaataattggaaaagacaatagtgaaataaagctttttcttttcactgttcgagctataatatccctcccaggtgagaggtattctggctgtaattcccaagggaacccttgtcacagtggcgtctttagtgagatgatttgatttttaccttttttcctttgggtggatgcctttctcctcttcttgactgtgcatgtgtcactctgtgcccacggagacagaaaagaataaaaagcttacctctccccctgaaatgcagcagagtcaaacttcagagttcagcagtttctcattgaaactatcaggcaatctgatgcagaaagacaacctcagacatgactgagccttcaaatagaagtttccagagaccaaacgtctcttttcctggatccccgatatggagagaagccgtgatctccacagagacttccaagctctctggcatcactttagcagagcagcccttgctgcggaagcagaaactcagagaggaagggctttgctgctggggctcaacaaaggtgtccgtctccagccagccactgttccaggtgcggagtacagagagggcgacacactcatagagttggtaagttcattgagaatgggtgcataacaggaaaagttttgattaatgtggagccttaattcaaaatgtggtccctgaccagcaagatgagcatcaactgttagaaagacagaaacatcaacccctctctggatctcctgaaccagtgcctgtgttttcataagataccccagggatttgaatgtgccttagtttgcgaagtgccatctagagtgtacaagaaccagaatgtacataaatttgactctaatcaactggcaatggcctcttcactatgctggctacaactctcttctctctcctgtgctccttatctcagtgaatagcagaaccatctatgaaaactcatgccaaaaacctggatgtctccctggaaacagccctcaccctcaagcagcttcataggttctctctagaatgtttctagaagctgcccatcttcactgcctctcccctggttccgtctctaagattattaactttctcacgggcttccttgccttcaccctcagcccttccaatggattccccaccctgcagttatgctgattttgctaaaattcaaatcttctcatgtatccctctgctggaaatggttgagtagctctgattactctcagcatgaacccacatgacttggtgtgacttctacctctctaaggatgtggctccagcagccccctccagcctcacctcatgcaacacccaagcctgcctgagagacaatagcagtatgcttcactggtgaaatgttttatagctacctggagtgcttaccctctacgtgtgagcaggcagtctctctctctctctctctctctctctctctcacacacacacacacacacacacgcacgcacacacgcacacatgcacacacacagagagagagagagagagggagagaaagagagagagagagagttacaggttatagagagagggagaaagtgctttctcaccctgagattattccatgaacccatagataagtcagaaccaggaattacataaaaggcccatgaaaggttaaatttaaaggatcaaacctttgtgctaaagaccctgcttcaaacatgtggagttcctcatggtcttattctctgagtctgcatgttgttgttaccacctgcttacctggtgctcccagactgttagaagcagaaagtgagaccaagcagagttgctaaaggcaggcactgatgaccccatgccagcaggactggcacccaggaaggagcagaagtactctagggagccaagcaggagctcagcggaggccagggtgagggcaggtgtcctacaaatgtcaactccgatggtagctgatttcaagctctgtttgatgacagatgttgatcccagtggtttcaagcttgagccattcaaggaacattagaaactagaaaggaaatattgcataggttcttcaaatatcagtttaccccgtgaaaattcaagctttagtcctaatgcttaaacagtgctgtattaaggtctgtgtgcacttcaaggttaaaacctgaactgtaaaatatcattttttacagttatgggcccttttatgctacaaccccagaccccctgagggccttctcattccttccttctccttccccctccctcccctgccatcccctcctctcctctcctctctccttccctttcctcttttctttctctttttcttctttccttccttcctgcctgcctgcctgcctcttttacttgacatttattggtgagtaaatactccatgccaggatctgagtttacaatggttggtggctaggatggacagtctggagtcatctgaaaaaggacagtcaagaggggaaggaccagccagtataaaggctgtgagttgaaagtcatagagagagtagtggaaagaaaggcccaggataaaccatgccgggtgattatcccaagtcctggtgaatgcatttcatgtgctttgttgactgtgttactgtatattcactagcaactgagtggataggggtctctccttatagttgggtgatctgttagccatctatggctgacctctaggaatcagggagggtcttttgatgtgtaatttgaatattagctatatctcaggctttatttttgctgccctcagtttatagtacgtagttttgtaagctgccttaaaaacttttagacacaagcaagttaaaagaatatgcagtagatttaaatgaggctcctatttaaaaacatttaataaaagtaatggtgtaataattgtgttggtagtcaaaaggtaaatttcagactgtgtgtatatgtgtgaaaagtcagtgtgtatgtatgtgtatgtatatatgtgtgtatataaatatataataacatacaatataaaatatacatttgacacacaatttaagtatacaggtttaagatattttaaagttaaataacaaatagaaataacatatgcatgtaagtaacatctaaattgttctatttaagtatgtaatttataaaataaaattatttaaacttaaatacattttatttatttatttgttattggtggattcaaaaactactgatgattagccttctgtattagttccttctgtgtctggtagaaagtcagtgtgggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgcggtggcgggcgcctgtagtcccagctactcgggaggctgaggcaggagaatggcgtgaacctgggaggcggagcttgcagtgagccgagatcgcgccactgcactcactccagcctgggcgacagcgaggctccgtctcaaaaaaaaaaaaaaaaaaaaagaaagaaagtcagtgtgatattgaaatatgtagagtggctgactgtgttttatttttggagggtggatgcaaagggggtagcagggagcttagtagcaagggacctcagtgagtcttgtgttgtcagtgaggccagaaattgatgtaggcggaggaactaaaacctagttcttcaattcctctgtataataacataatgagactctggaagcgtctctaaaagctgctggaggaagcttcaaggacatgcagatgagtggaaatgaaggagcaggagcaaagaaaggtgacctccatgacagagcaggaagctacaggctgggactgttggcgtcaccaaaacattctctgcaggagggatagacaagaacttatagatgacagcatctaccatttgattttaggattttttcagtctttgcgctgtgtggcaattgtcctcatcctacatctccctgtataaaacaggtaaccacagcagacttatgtcagcagcactttggggaatgagggagagagagttgcattttatgcttggcctcatgcaagctggagaaagaacagcagcttcaggagatgacgcagtggcaggaaccagaggaaaaaaaaccacccatgaacattatccaagagtttcttttttaggtgataaaatcatgagtttcatacaaatagcagatgaacattgagtcaaatattttatttaactcattcatgaatgagggaattgctaagatgttgcaactggttccattgaagattctatccacagagatttgttttctatggggcaaaatgtatttgcagcactgagaacaggagtcctttgccttgctatggacaggaagtgttttcattgctttatgttttctatcagttaacctctatctctgcagagttgtaaacagtcaagtcaaagacaagctaaggtatagataggatggatggatgaactggatagggcatttaatgcccacttactcaatttctgcccacttccacctttcacaattctgccggacaatatatttgagacggtgaaatattcgggaagcctctggacagacccataaatcgtagtctttggatgtggactttgtttataggtggggaacctgctgaagattagatgagtttgggtgggttgagacattctcgaaagcaagaaccttgtctaacatcttttgttgccgaggacctacatcctgccccgtagaattaacagttcgtaattattggccaatagccaaaatgtcaggattaaaattgcttacctctcagaaaaattaaaaatacttcctcagccttggtaaggaaagaagtgattaaacatctagagttttaactttctattaaaattttaaattggaaagaaccatagtcatagaaagcattcacagcaaactttaggaacacacaaaagacacgtgtgtaccagggagcccacgcacgtctgggtactattgttaaaatgagaagaactaggcacactaatctattccagggataggatgcttgaaatggacaaatagtaatctaggtttattaatgggtattcatagttgttaaaggaattatatataaataatttccaacaaacagcttaagaaattttaacttatgtttaattataacatgcctccgttatacaggaaaataaaaagaaaaaaattatcattgtgtaatcaggcaaaaacatcatggcttgttgatcctcacaataatattgttaggagaaatagctattaaagatataattcccatggtaatttcctgttgaaatgtttggccagtgacactaaaaccaagccaacttaaataaatatattgcccgtttaagttgatttcacttaaaaataacccacagtaatatcataaatgcctaaaaccatacttatccataataggtagctgttttttcctccttactattcaaatagattcgacatgaaatgaaagtaaaatctcacaatggtgaaagacttctggaaattttaaaatagatatttgctaatttgtaagtcctgcaagatcatgaggagtttgtgcttttctgcagatgcacctgcatgtttacttttcccattaaatgacatttcttctgtttctaatcttctagagatgcagaagaattgcgtgggacattttaaaatattagtcacaactaatttgtcatcaaattttgtgagatctttcactgacacagatgatcagtatataaaaagcaagtcaaatatactttaaaaaataattacatccacagcaccacaactctaccttaataaaaatttcacaattaggcgggctgtgtgtcattagcctccctgatagcattcagtgtattgtcacctcatgttcaagcacacatctgatagaagcaagacattctgccacctcattccaccttctctattttacacctttaaaagtgtggaggtagtgtgctaagagttataaattgtcttgctgaaattctttgggagaaaacatagggggcttccatataaaataaacagtgagactcaaaaattctagaatcaaacatttattgccctctgctgtcagggtccacctcctgggaatgtgtgttaccttttgctctaattctttttgaaatgtctccagagagtatgaaaatgtagtgatttctctggttttgattttcaaaaccaataaagtttttcctttagtccaatttttaaaacacaaaatgttttcaaagtatacccatgttgtagtgagtaaaaattctgaaaaattctctatattaaaaaataaaaataaaaaagttgagtctagaaggggcagagagcaaagaacagtgtgaaatatctacagatgacaaagacagtcattagctttattattttgggtgctaggcacgtgttttcaatgtagttatactctcccacagctataagggcataaagctacatgttagaaaaagtgcttctgacactacataagtgtacaatagctacgtttagaactgttcagtgtggtcatattttaaaattatgaaatgtagggaagaaatgcaattatgtgaataaaaagactggaaatggtcttcatttctatgcaaggatggccacaaaaaaggtgacatggagccattttcatgtacaaataaatgagaaataatctcacaaggaggtgagaggctgcacttgctcttccccccggagtggtgttgccatggtaattatagtgacttcagacacttctgagatttctggtttcacactcaactgggaacggcgaatcgcctctatgggtgacaggatccactttggatcaataagcagtgcacgtgtgttccgggtctagctctgcctttcatttgctgtagcttcataaattgctctgtccctcactcaactgtgacacgggtcctgtctgccactccgggttgttatggatggagagccaaaacgcagctgctcaggaagtaactaggcagtgcatgtgggttaggatggcaagatttagtctcatcatttgttgtttccacagttgaatatagttctggctttattatgaactttaaaaatcagaagaagaaaatcacactttcgtagtgttgttggattatttttggtcatttccactcatactgaaaaatgctgggtatttgagtccatttcattgttcctgagcaaggctttcctttgctcttgtgagcttttttttttttttttttttttggagacagagtcttgctctgtctctgttgcccaggctggagtgcagtggcatgatcttggctcactgcaagctctgccttctgggttcacgccattctctgcaagctttgcctcccgggttcatgccattctcctccctcagcctcccgagtagctgggactacaggcacccgccaccatgcctggctaatttttttgtattcttagtagagacggggtttcaccatgttagccgggatggtctcgatctcctgaccttgtgatctgtctgcttcggcctcccaaagtgctgggattacaggcgtgagctaccgcacccggcctgttcttgtggtctttctacaggaagtgacttttgctgcagggagcttctgttgggggaaaaatgaatttaatagttttgaaatagtgggttttaaaaagtgtatgcccaagtttatttgacttacagttttggaggctgagaagtccaaggtcaaagggccgcatctggtgcgggccttctagctgcagcatttcagggtgtagggcatcctaggcccagagggcaaaagcatggcctaaaagagttgtttttttcccagatgagaataaattgttaattctttcccaaatcagtaattttggtaggttgactaaaatgttttctgattgcatcagagaaaagatataaatattgatatttagagtgccttttgaccttgagccagtatcatctttaaggtccagttatgtgaaattcaaagtgtcagtgataatggccttcctaatgtacattctttactgtcacttaaactttctgcactcaaaaccatgtggcacatcgctgtttaatatgacagtccagcacgaggccttacattcacaaccttcagtagcaacagcgtcaaatttctatcatcaaaattgtagcatgtaaatatgtcacatgaagataggtttcaatacagaatgtacgtgagagataagtaatgtctacaaacattaaaaattcctcttgactatgtttcaagtttctagaaaatgaagtatgatatttgcaaaaatatagcttcaatgtgttatgcatagaacttaatgtgtgtgaggctatgaacaagactgtctcagtctctgacctgttatttgttcacactgagttcagatttttaaagggaagaataccaggagggaaagagcaatactctctcttccctaaaaggctttgggaaatgctttatctcatgtgttagtgattctttaacttttgtgtatacagccacatctagaaagagactatttccttttctaacaggagcctatagatttctaaaaggagcctaagtcagggcacaaggaactgcctctgggctgtgaggctggagcagcctttgaacaaggactcccagagaaatggcgtttgaccttcctctgcctcatttctggcgttcttgtttcttaatgttgggtgcaggcagtttctgtcacagctgactgagtttgggggtaaaatattgtggcacaatatttagttttgtttaattaaataaatgacatggtaaacaaatctcatacatgttgctatcatttacctggcacaaaagaccattagctgtgtgtgtgagtttgtgtgtgcgtacatgcatacgcatgtacacacacatatgtctgaaaataagattcaaaatatttacaacttatttttcttcactgctaggatattcatttttactgctgacagatttttaaaaatcatgtcagtccatgtggagaatcccatgtgatatggtctggctgtgtccccacccaaatctcatcttgaattgagctcccataatcccctcgtgttgtgagagggacccagtgggaggtaattgaatcatgggggcaggtttacccatgctgttctcgtgatagtgaataagtgtaatgagatctgatagttttataaagggaagttcccctgcacactttctcttgcctgctgccatgtaagacatgcctttgctcctcctttgccttctgccatgattgtgaggcctccccagccatgtggaactgagtcaattaaaactctttcctttataaattacccaatcttggatatttcttcataggagtatgaaaatggactaatacatatgtgagatgtttctaaggggactaaggaattaagcatatcagaaaacatagatgagcagatgttacccctgcaccgttaatgatgatgatgattgtgtacttccctgagcagatggaagcactgggctttatagggtagtaagagctgagtttcatgtccaatggacctgagtggtgagtggctttttcatcttggttaaattactcatggccatgtctctggcttcatcacatttaattgaggacaataatagaatttataggattacttagacgttgaaatgcctcattgcaatgaagcacttagcacagcacctggcacataggtgggcttctgttcttacagcattcttcccccttatctgcagctccactttctgcagtttgagttttccttgatcaaccatggtctgaaaatacatgagtgcagtacagtaagatgtttagagagagagagaccaaattcacataactcagaatacagtatattgttttaattgttctattttattattatttattgttgttaatatcttactatgtctaattttataaattaaactttgtcacaggtgtggatgtatagaaaaaaacaaagcatataaaggattcagtactatccgaagtttcaggcatccattgggggtcttggaagctgtgtataaggcagggctactgtatttgttattttgttgcagtcattgtaattagttgtagttgtggtagtagcagtaataacagtagtgatcattgttagatttatagttctttgctcaaaatctcagttcaacacctgaaattaaaaatcctccctattggccaagaactgattttttaggatgttccatatattttgaagattatatgtaacaaaaagtggctataattttagtacaatgtaactttttacaatttgctattttatttggtgcatagaaattaaggtcatgcaatcactttggaaaatgaccaatctttttaaaagctggctctgtgcctaccctatggcaaagccattccactcccagctatgtccccaaaagaaaaaaatatttacctatgtccacatgtactacaggttcccaggtacacacaggcatatacagtgttcttggcagcacttttcataatagctccaatcaaaaaactatgcaaattcccccaaacagctaaatggagttatgttcattcaatataatacagctaagaaatgagaatgaacagccaacaactacacacaaccatgtggataaatcttgaaaaggtaatgttgaaggaagagagacagacacaagagaatatattctgtgtggttctatttacataaacttccaaaacaggcaaaacgaacctatcctattagaaatcaagatactgggtggctttgaaagaagagtaatgactataaagaagcatggggggtggggctcaggggtcctggtaattttttttctctacctaaatgtgggttgcatgggtgggatcagttggtgatgattcagctgggctattcagttaaatgtactcttctctaggtatattacactttactgacaagttttttaaaaagacagaaaaaaatgtcagtggagaaaatgttgttattttatcttttaaaatactgaataaaatgttaacaatttaaatgaaaatgcatgattggattttagattaaatatatcattttgataatattctaaaataattacaaatttgtgctcaaatgaaaagcagacctctcagtgttaataaacactgtgtgtaattcagttcctcaagtagtatgggttttatcactttcttccaaaacataaaaaagtgaaacttactaagtttcatatgctgttttaatgggcaggttctctggaaaggatgtaagtacatatggtggaaataattatagatgactcacggccatcagtggaaatttacacgtcctttggaacttcaatactgagcatctgagaaattgcaaatttctactatagaaaagacgatcagaaaaaataccgttttcttttttttgccattatcattttttaactatctccttttttgtgtgttaagcatggtatctcctttttcctatttcttttccttttcttctggttcttatcttttgttagatcaatttctgattttctatggcagatagagagctggttttatttttctagactattcagtgaaaaagaattcatattcctctttatttgtgaatattgtatgaatgaggtttgaacaggtatattttgaaaatttctttttaaattaaaacacattttatacttttccacattgagatcctaaatgcctgtgggctgactgcagtcttccttaaatactatttaggaagttatataacttttgttttctttgagctcttcccaaatattccaaatttcatgcaataaaatatacttatttgtactttaaattttaaaatgaacattatttttatcaggtcttggcttgcaaaattatggtcacaggactaaggtgagaaagtaaacgtttttcctactctctctgaattttccctcaagttttttttggcagttcatggttaattggattgttcacgtagagaactttccactcattcttcttattgaggccttagcagggaacactgtataacatagcctacaatgactgatttttgagcccttcccatcaaagctttccctatgacctgccctgcccaccacctaaccaatggttagtcagcaaagaataaattctttcccccaaaactccccagttatagtcttctgaaattcctagagtcccttctgtcctcaccttaagcacattcgaaagctcattgtttagttaagaccacaaacattttagctgataaggttgtgagcaaactctattttaaacatacctcttattaaatgtttgtgattgtcactatcatcatcaatattattatgataaattgatcactatgtgccagacacttacctgtgcattttgcatgcaatatatgcatattaatgttatctaaaaattaaagccttataacaactcaatgggttatattagcctctaaactgaggctcaggaaagttaagaaatggtccaagtcgtatccatgatgaatggctgagctgtagctcaaactcagagttgactgccctttctcatgccatattatctccctaaaattatcgatataccttcactaagggccttcaaatggggaccctcctatagaaatacaaggacgtttctggcatagcccctttctctatgaggtggttagtacagcatgggagtgaagcacccaaatggggaccctcctatagaaatacaaggacatttctggtatagtccctttctctatgaggtggttagtacagcatgggagtgaagcacccacccaaagatgaaacacttgtggaggaaagaagcctaataggattggataacctgacagatagttcgaatgtcctacaaaatcaaaaatggaatgaaataccaacttacacacaaaagaaacttgaaactactcaaatggaataggctgatgtgtttttttttaaattttatttattaatttatttatttaagacagagtcttactctgttgcccaggctggagtgcgacggcacgatctaggctcactgcaacctccgcctcccaggttcaagcgattctcctgcctcagcctcctgagtagctgggattacaggcgcatgccaccaagcccggctaatttttatatttttagtagagatggggtctcaccatgttggtcaggctggtcttgaactcctgaccttgtgatctgcctgcctcggcctcccaaagtgcagccactgcgcccggccaggctgaccattttgtatgggaaagtcagcactttcgtgaatgaacacattgatcaagccactgaggaaaatgtgattcaaatcataaggaggccaggacgaaggtcacacaaagagcccctgactctaatctacaatcatgacgaagggggccccagtccagttctaggagaagcctccctgccacatcctgtgacaagtttcacaccagcagggatcttgctgagccagttaggtgggctgagtccagccctggaagatgggccatcctcgtgtccttctgaagggcactggcctgaatgccaagacctaaataaaagcagattttgaaggtttaaacgtggaataaacccaagagtgacccagaggagccagctgaagtgctaatgcaccttcacaatcaaagatatgaaagcttgtcattaattgcgcacgacagtctgaaggaggagggtggagcatcttgctggctggagaaacttctggaaaccttaagtgctctccaacttcagcatccagggtaggtgaggcaacagcaagcctactgactgtttggggtgatgggcttttttttttcctggagagatgccaatcttcagaagccctgagagcctgcagagctccatggaaggtctctggcctaggtgcccaggtgtgggtctgcctgcactgggtctctgaatgagcagggctccctcgcagttctcgtcgtgggaaccctcagaggacacggcaagaacaacgttcccctcagtctctaatggacacggactgcccttcccaggcagaacgcacgcactcgcctgcagaaaccttgagttcaccattatttattatgtctgggggatgctgccatcccctgtgatgcccctgattaatgataatgtgcaaacctgaggtaattcgctgacatgttagatctttgtgaggcaccagaatggaagcggcatttttcaaactctgctctgcgggagccccaggggctgttccagctcaggggggaaggggagggcggcagctcccgcggctgctgctccatttttagctattttatgtgtttatttgtttacaatgcttgttaggattctggatggacaaagaaaagtattgcctacaataaaagaaagaaagaaaaaacaattaaatggaatattatatgctgcaaaggaacatgccaaggggtgcttggaccattttctggaattttccagtactgaatatgcctttgtatttttggttgtgtttttttttaatatttattatatatatttttgaagacggagtctcactctgtcacccaggctagagtgcagtggcgcaatctctgctcactacaacctccacctcctaggttcaagtgattctcctgcctcagcctcccaagtagctgggattacaggcgcctgccaccacacccagctaattgttgtatttttagtagagaactggtttcaccatgttggccaggctggtcttgaactcctgacctcaggtgatccgcccgcctcagcctcccaaagtgctaggaatacaggcatgagccactacacctggcccttgcctttgttttgatgatcgtctgcattcatctgctagggctgccacaaaaacatgccactgagcaggggtttgaacagcagtcatttgttttctcatagttttggaggctctaagtccaagacgaagctatcagcagggtggttccttccaacactgtagatggcacctcctctctgtgtcctaacgtggttgtcctccgtgtgtgtctgtgttctcacttccacctcttccaatgacaccagtcatactggattagggctcatcttgatgacctcactttaccttaatcacccctttgtaggccctatgtccaaataccttatcccgaggtactgggggttgggacttcaacatgaattttggagggacatcatgcagcccataacaaaatctgacaatagttgtatatgcacattctgtaacacatagaacctgtatgatctacctgataggtgaccgctgcccaatttcagagccctcagttttggtcatatttgcgctggtgttaacaccaggctattatctaaggggtcggcatccgcagtctatcatgttggaaagcatggcagccattaggttggccgttattgtcagatggcttctcagccccctcttgatttagttactgcctatgtcactggtggattcccaataagctttgtaattaattccagtacttgcctttgtctattcaaattgtacatgcagtataaccttaaccacctctaggtccaaaatgaatgtgccactcttggtgccactctttgtgcctgcagcacattctgcttttctaattcattctgctctcctttagtttttaaaaagttaagagccgttacctagccgtagctggcaattcttgcttgcaggtaaactgagttgccatggctgctttttaggaaggtctctgcctggttggtgaacagcccctttattcccccagaacaacatggatacttctcctcaaataaatccgtgccccgtatggaccgtccgctttgccagggaaatgggtttgtagcccactgagagggctgacccatatgaccttagcaacaaaaatatgaagtgcacagctgtgtttgcaccatcagcatggccaaacaccctttctcttctcgtttctctccacacagtgatgtgcattaactggcacctggtttctgcatcacacatgcatattgggagaattgttattctagaaggggatggaatgtgacacacctcagataattgctctgagaaatgagtatgaggtctttttaaaaaaactttacatttaaacacacaaaccatttaaaaaaaccactcctccaaaacagacacacaagtgaaacaaaccaaatcgactgtccatccatttaattttgaactatctgcaatatcaccttaaagctctaagctcctaatgattttggtcattacaaatccaaaataacattatttcaaaatgaagttttactatgatttttcccatttgggaaacagtatatccaatacaacaagatgcatgtgtacctccattaaaattttaacaattaggaaaattagaatttatatatgatagattaaaatatgattatttcctaaaagttttctttagttttacgggtttgcttctggattgctttcaatagttattagtgaatttaaaatttgattcagtatgaaggtaatgtacacccatcttcttcagaacacgtattttaaaatgtgacatcatctgttctgagtctaagcactgaagaatgaagtgtccacattcaccgtatttatgcacagacacattctcattccattgacatttaagtgatgtaatgaactaaaactgccacaaagagaggagggttgggaggctgagctctggacagctctgtcactgggcaagtaacatggtgtttagaaaatctctgctcctttctgtgccattggtctatatctctgttttggacaaaaaaccaaacaccgcatgttctcactcataggtgggaattgaacaatgagaacacttgcacacaggaaggggaacatcacacaccggggcctgttgtgggatggggagaacggggaggaatagcattaggagatatacctaatgtaaatgacgagttaacgggtgcagcacaccaacatggcacatgtatacatatgtaacaaacctgcacattgtgcacatgtaccctagaacttaaagtataataaaataaaaataaaaattaagtaaagtaaaataaaatctctgctcctgtttgctgtccccactgataaaatggtagagcagatcactcctaagtcagagcttgtgtaatagctgcgtaggagtgtgaaaccaggctacttgggagccagtgctggctccagaactttccagctgcgtgtccttgggcaggtggtttacactctgttgcctcagtttctccagcaataaaataagaaaaaaatcatagccagctgatcaggttgttgtggaggattacattattaaatcttggccaagccctcggagcagactgtaaccctagtactgtctcatgcataatcagttactgatgttgttttaaaagcactgggttaaaattgctgcacctaagatctagaacctgccctaccactgcctagctgtggtggctggaggcatagagccccatagttgtggaaggaaggagtggccccaaaggcctctacctagtgaagttcacttccccctgcttccttccctaatgtggtttcttagagttgacataagcatatttctctgacacacaaacagatgactttttctgcaggattggtcagaactttagaagtaaagtgctcgagttgatgagataatttgcagctaactgcttgaagttcatgttggttatgctaaaccttagagaaagaaagctaccgtttctgaatctttaccacttatgtttttatccgctctgacacattaaagggagaaaaataccagtaaagaaatggctagagaaaatggaatatgacagctagggtctagggaggaaaaccgtgaaaatgtctgtaatgaaaagaaaattgctagacaaaaataatttgtaatttgtcttctacatgtggcattctaagactactgaatcaatattgcaagttctttgttagccataataatagtaatttttaataaatgcccaggtgaggtggctcacacttgtaatcccatcactttgggagatccaggcaggaggatccctttagtccaggagttcaagaccagcctaggcaccatggggaaaccctctctctacaaaaaatacaaagattagccatacatggtggtgcaaacctgtagttccagcttcttgggaggccgaggtgggaggatctcttgagctggggaggtcaaggctgcagtgagccaacaatcatgccactttgcacttcagcctgggtgacagagaagactttgtctcaaaaacctaataaacaaaacacttcaggtgcatgactaagagtaagcttcgtgttgggctcaaaatgctgttcagttgaaggcgctggagaagagagggcagaaagctcttggactcttggacagcctcgcagaagcaaaccttgctccaatgagggaggcaccaaatggcacaggtggctttggcaggacgttattgtaagcctgccacgtttccgtggcatacagtttaggatccaaggttctttaatattgtgtttccatagctttttcctgcaaggcagacacgtaacattaatgagctcacagcactcttggttttagtcgtagttactgaatcctcattggctgaaaagctttgtgtattaagttacacaatttttttcttttgcatccaaacttgaaataaaacataccaatttgattattttatattaattataacatgacttacgtcattgtggtttattgaggttaaaaattgatgtgctatactcagaagacagaaatgattattaagataaaagaggcccctgtaattctatgccccagagattaacattttaaacatgttggaatagatttctcctttcattttgcagtgaaaatatatgggattacattattctaaaaccgttttttccactgaacctattacagcacttttccatggactacatatgcctcattgttaaattttttagtcaaacactacatgcaaataattttaatgtcatatggttataaagaaattataacaacaaaaaactgagaatgcattccccgttttcctcccacgaagaaatcactctcattattttttaactaaatttctggtatttaatttttttcaatcttattcatgtatttattgacttcatattgtgatggttcagaaatttaggtcactttgcccatattcccatcctcccagtatgtcttacattttagttaaatctattataatcatgtaaatattaagtgtcaagccaagttgtgtgctatgattacatttttcctttttgctttaaacatctaacatttccacacttcaaagcacaaaatgattttccacatgttcaactttgtcagggaatttattctattttgtttttccagcagagacagctccaggagcccctctaccagcctccaatctgaaggggctgccaccttaagtattcttctcatgtctcccctatgctggatttcctatttcctaaatcctgtgctttcccatgtctttttttctccctcctttcagcgggacataccatccatcatttctgagaaaggatgcatgagaagaacatttttaagaacttatgtttgcaaaaagaatataagtttggaagtaatttttatcttagaaattttaaaaattgcaaagggaatgatttctccattgtcttttagctgccagggtaggggttgttatagttctgattgctgaccttcgggtgtaagttcactttcttccttttgggtgggcagtgttgaggccattctctttattcctgaagtcccgtaactttatgaaggtgtgtgtggctgtagtgtgctgggcactgagtggcatcttggaatgcaaacactcctgcccctcaatgtagggtgatttccctgtatttctttatggatgataccattcctactctttccacctttctctcccgctggaatttctactgttcaaacagacctcctggatggaggtaatttttttttaaatctttattattttgttgtacaaatctcctcctttttgacagttcagaaattttcgacttttggttcttttctttatactaactttcagaaaatatctacacttccatcttaaatacccaataatctgtttcagtttagccagagaataaaccccttaggctatcgagatgcttctggaagcagcataatgtgcagctgaatgtgcaggcggggcacgaggacgcagaatttcaggaaacccctccttgttcagcccttgccccactccaaaccccaaaacctttgaggcctccccctccccaatcctgtgtgcaatatttgctgtttttccatttactccctgacttcagattgttgagcttgagttcatggacatttcatagtaaccctgaaatattataagtctctgaaatagtgtatttctcttcctttctcttctcgctccttctcttcctcctctctctgtctctgctatgaaattaactagtttcttattacaaaccaaaaagtatctcagacaggtctcaatcgattgaggaggtgcacccaggacacaggtctgtgccttcctccaaagatgattttgagggtttggggatttaaaggagaaagggcagatattggggaaagagaaagagaattttaaatttcagtgaatctttatttttacataagataaaataaacatagggcagaggaagcaaatcagatgtgcatttgtctcagatgggcagaggaatgactgagttctgtccttcgtcccgcacctgtgaagataagctatcaatttatctcgtcagggtgaaatgcaacagaactattttagggtaaagatcttggggcccgcaaggaatttcctagtgggcaaattgtgagggagctatgtagtttttttttttttttttttttggttaatctttgtagctatcttattttggaataaaatgggaggcaagcttgcctgatatagttcccagcttgacttttcccttgggcttagtgattttggggtcccacgatttattttcccctcacataattgatgacattttagtccttattcctttacttttactatttttaaaattgcttataaaatcccaatatttgtgtattttttaatcaattcttagataagttactgcttactataaattcgtgtacattttacaatattccatattttaacaaattaccctcaaagacatatcaaattattaagtttcatttctggaaagtatgtataaaagtgttgattcttctcttacacttcctgacattaagcgttattttttaatcaattttatatacaagtcaattttatgccatcattcatacttctaaatacgtacttttagaaagctacatattcctgaaaacagaacacttattctttccacacaaaatagtcatttgaaaacttctgcagatatagacaagtaagtcataaaacatttaaatgtgtttacagagatcaagactaattattttgtagattaaatctttgtgtgcgtgtgtgtgtttaagaagattgtggggattaaatcattgtgtatatgcacagtgtttaagaagttaatgtgctggaattaagaggcaaaggcaaataaaattgtttctaaaaatttgtgacctatctttgtgtcagaaacagcttatatttaaatttgttgtttctataagtccacttaattgtcttgattgtttaaatacaggtagagtaataatgatcaaaatctgggagccctctggtggccaaaatatctttagctacagacatacatctttggcttatgttctaggttctcaagatctagttattttaaacttcttgaaagtataggcatttaaaaataatcaacagatgaacaaagtgaaataaacaagaaaaaaatgtaattgcattaggaaaacaatgtaaatttgaaaagtgatagccaggttcaactcagttcttgtaagtgtttttggaaactggcaaaaatcaaatgcatgtatttgtccgggagaagccacagtatcattggaaccttgtccactctcagcaatgcaaaagccctttgaggtggtcccatagaaatttataacatgttaccctcaatgaagtgaaggcatttaaattggaggaaaaaagaaaagaggtgtgttagctgtcttcagaggtcagaagggattctttgtcataggatcacattccttacctggacagtgcagggagaaacggaagctgaaaaaacaaaacaaaacaaacaaacagtttcaagtccatttaagaaataaattattattaaaaactatttttaaaaatggactgccttgataagcagtgagttgcccatcactgtgagtactcaagcagggagatggaaacacacttgttagaattgccatggaggggactcaggctctcaagcttgggtctaaagtacatggtctcttccagtgctgtaaccctggggctacgtggatcaacaatcaaccatcaggtaggaactgttgatggcctcagagcctgtctctttaaatcagagtttcaggaatgaaaagtgatattggcatgagaggtcttgggtctagacaggagtgaatgtcatttgtctcaagttctaggaggggtagatgtatccagctgcatgccgccttacttctgaagggataaaagcagagatggcttctgatctccagcaactccttagttgttcataagcaatgaatttagaatcacagatgggaccacacatatgtctgtgggatgctggcgtttctttctgaacaacagttccatttttattgcactccttgtgaccacatctgcatgtttcacagtctttttgagatttttgcaggcatgattccgtcacccaaaacagcaaggatatgctactcttatttctatgccttcaaaaacaaacagatctgcagatttgacaaccttgctgaaaatattttttttttttttaccaaacgtgtttataatcaaacaagttgtcagaacaaggggtcattgttgctttctcaagtatttcaagagtaagctgtaatggcatttggagagagaatataattttattctctagaacaggggtgtccagtcttttggcttccctggggaacattggaagaagaattgtcttgggccactcataaaataccctaatgatagctgatgaactaaaataaattgcaaaaatgtctcatgttttaagaaagtttacacattagtgttgggccacattcaaagccgtcctgggccgcgggtggcctgcacgccacgggtgggacatgcgtgctctaaaggaaatgagatgaatggctcgtctcattatttttaatggaacagagcttctgtagttgatctggatccatttgaacaggtgatttaacccacttgggtgcctcagtttactcatcattgaaggtaccttttcacatgcagttctatatcaaatgttcaaacagagcttttgggagacgtttaagctcagacctgaaagaagagaaagagccgctcatgataactggaataacagcattgtggggagagagaaaagcaggtgcaaaggaggccaagaagcatttcatgtgtttcgtgcagcaaaaggacaacacatcccaagccaagtagtagaaggatagattgatgagaaaggatgttgaagagacacactgatgccagatcttgcaagatcttatatgtacatgaagggaattgggatcttattttagtgcaaagacgagccacttttaagcattttaaacagacgaaaacaattttatttacatggttcaaagatggttctgggccagatgcggtggctcacacctgtaatcccagcacttcgggaggccaaggcaggcggatcatgagataaagagatcgataccatcctagccaacgtggtgaaacctcatctctactaaaaatacaaaaattagctgggcatggtgatgtgtgcctgtagtcccagctactcgggaggctgaggacagagaattgcatggatctgggaggcagaggttgcagtgagctgagattgcaccaccgtgctccagcctggcaacagagcgagactctgcttcaaaaaaaaaaaaaaaagatggttctggggagaatgaattagtgacggaacaggaacagatgcagagaatccaggtgcacttgggactgaacagggtggctctttcaaagatggaggaaagtgggtagaagtcggatatattttaaaagtgggctggacaggagtaccctgatgttgcaagtgaggaaaactgaagagtcgcaatgactcctgttttgtttttgcttggacagtgcttgtagatagaatgaaaagcaatgcctttgtgtgtatgggggttctaaagtgagggagtcatgaactgaggctcagctttgggaaccttacatttaagtgactgtgaacagtttctaccttcctctgagcctgttctctatttttccccattgtactcatcactttctaacatgctacctagtttatttatcttgtttattgtttcttgtcaatctccctgctccacctgctccctgctcctgcattgaaaggaaggtccatgtgggcagcgatttactgatttacttttattgatgttcccagaacagtcccggagcctccaaggcattcagagaacctctgtagaggtgtgaaggaagcagtcaggctgcagagttcaaaagagagacttgggagatagaaatgtgggagaaattcatatgtggatggtaaaatcatgaaaatggatatggttacctcaggaaagagtgtgcagatggttcaggaaacagctggagaatctctagttgatgtttggaggggaaggatgagatggcaaagcagaaccagcagtgggcattttatcaggtgagaggttagagggggattgtcctagaagccaagaaaagagaggaatttcagaaaaggaggtgctcaccttcagaggtgctttctagtgaagtatgaggtaaggccaacagttgcgggatgggtgtctagggatgagaagacaaatgatggagctcagggaacaagaaggatgccaaagaggctggaagcagatgttaatgatggtgcagccttctggaaccagcctctaaggagcaggggtctggacctgcacatggatgggtggtgccaatctgtgatttgaaagccagcatggggaccaaggatggaccttctctttatctggtcctgatgaaggtcaggaagagcagcagcctatgttgcaaaggatggggtgagattgggtctacagaggatgcccaagtttcagttaagacctggggaaagtggggatgatcagagcctatgctgctgatattggaggggaatttcagagaacacactggaagaactgatggaagaaggggtgattggacaaatgagcagacattcagtgcaataccgggtggtctcggtatgagcagtgaggcttgcatttctgatgctgattgagatggacagaagaatatcagggcactgggcatagttgttattggatgttcagctatgtccagctcaccacatgtgatttaaactaggcatttggggtttatttttaaagtgcattttagaaattcccagataactccttgcttgcaagccattatctagtaggtgtgcaataataatgagcttctcaatgccatcattttagtatcctaaggaagtatattacaatgctcgttattaggctgaataatatgaaattgctgttttatatgtcaaatgtggaccaatcaagcaatttcagatggttcaacctagcactccttatagcagaaagtatgtcaaagaggaaatagtagcaacaattgcagtgatacaataaatcaactcttgaaaatactttgaactatatggaataaaaataagattaacatttctattttgcaaagttgaatatcagttgacttttcagaaatgactgggggttgggaaatgactcttctcctggcccccacatttaccatgtggcacctaactctgatcaggtgctacaagtgggaattctgctctagctttcaccttagggttgcattagaatcatctagggattaagattcctgacactcaggctgtaaaccaatcaattagatcacctagggatggaacccaggtatctatacattttaattggccctgagtggtttcaatgtatcaagattgagaactattgctctaaaccagtgctttcaaactgtcatgcatatggttcacttggggatctttattgccacctcccctgcctaagcattctaattccatgggtcttgggtgcaacaaagatgtgaaaattttttaaagatctccacgtgattccaatgtgcagtaacattttggatgccttgctcagtctaaaccaagagctacattaagccagcggttctcaggcatgcatcacatcaggcttacttggaggacttgtcaaaccagagtgttagccatggctctaagatttttattccagctgccagaagatgggtccaagaatttgatttgctaacccattctcaggtgacacttctgctactggtcttggtgccacatcatgagagcctctgtaccaggctctaatagaagtactcttgggttcctgtttgtgggtggtatggctgggatctcctatattccctgcatgaaattttcttatctgaacttgcaggaaggagttccaagaggaaagacgtgggttaaaaatcccatctgctccctactgcctccttatcttcctgtggtcatttttctattcttttctgccatattcatttcctgctgctgctgctttaacaaattagcacacacctaagtggcttaagacaaagttattgtcatactattgtggatgtcagaagtccagagcgttaaatgctctcagtggtctaaaattaaggtgttggcagagctaggtccctttctgggggctctagagcagttctgcttgagtttcccagctttttgagacaacttgcagctcttgactcacaatccattagtcccttctctctgcaaagccagcaatggccattcaagtctttttcacattgcatcgccggctctgatgcttgcttccacttttaagaactcatgattaccttggacccacgtggataatccaggctaatctccctacattaaagtcagctgaggagcaaccttaactcccctttgccatgaaaccttacacattcacaggttctgcggattgggatgcaaacgtatttgtggggggattgggacattattctacctgtcacacctgcctccccccagaccccagagctggaatgcttgagtgtgaaaccagctctgcctcttagagctgggttacctggagcaggtcatttaacttctctaaactgctggaacccagggaaataaagtatctacctcacagtatttgtggcagggctacctactgtgggtaatgaatcatatgtatgtgtgccaggtcctggaaaagggattttagaaaatgttattattattgttataatgttcatcttttgcaattgtattaagagtttctgcctatagtcacacagttcctcatttcataggcaaacaccagtttctcgggtatcctttcagagctactctatgcatgtataagcatatgcaaatatataatttatttgcagaagtggtaaagtattatgcctatgtgaataatacttcattcatgttttttctttcttttaaacagctgcattgttcctattttatgaatatacttcatttacttagctagcctttattgatgaatattttgtgttcaattcttttgcaactatgaacagggctgtaactgatagtcgtataaatcaataagcttgcatatgcaccgtatatctgttgtataaattcctagaagtgagtcttctgaatcaaaggttatatacactttaaacgtgtgatagatgttgccaaatttgtctctgtatatattttatccattttcatttccatcagtactatgagaatgtgtatttccatatctctttggctgattcatgtcacccagcattattatttctgccgttctgacagttgagaataacatttcatgttttttatttgcatctctcttttgaagaaaaccagcatcttttcacacatttcttagcaatcatatttccttttcaattaactacccatttatgtccctcatccatcatgtttttgggtggttgatttttttctttaatggataattaataggatttactcacagtttaaggaaagatctattttctgtggtctaaattacaaaacattttcctactttgtttactttttgcttttgctgtaaataattattttttatgtggttaagtttctaagttgtttatggaatcataattttgtatcatactcagatctttgctatcttaggctacagaaaacaaaatttcccatatttttgtctaataataacattattttatgtttgtcatttgtatctctggaacttgtttttattttttatttttatttttttcttccaactttttaaaacatttaatgatattctattttaagttctggggtacctgtgcaggatgtgcaggtttgttacataggtaaatatgtgccatggtggtttgctgcacctatcaacccattacctaggtattaagcccagcatgcattagctatttatcctgatgctctcctttccccaatgccaccaacagtccccagtgtgtgttgttcccctccttgtgtccatgtgttctcattgttcagctcccacttataagtgagaaaatgcggtgtttggttttctgctcctgtgttagtttgctgaggataatggcttccagttccatctgtgtcccagcaaaggacatgatctcgtggaacttgtttttatttgatgaattcgataggaatgcaattttagttttttccacaagttccagttgcctcaacaccatttatccatacttgattctgtttttcctaccgattgctaccttatttattctttttttttgggtggggggcaggttttctttaaaatctggttgtttttgcatgtttactttaaaactggattactttgctggagaaaaaaatatctttcatattttgctagagttgtttgaaatatatagattaattcatgcattgctttctttaggatattgtgttcccatcttaagtagagtctgcattccgcttactcaatggtcattttgtgtagtaaagaagcatttcaacgtgctgttcatatggtttgtacacattttttatacttatgctttttgtttctattgtgcatggatcttggatctgaaagcatgcttctttgtacatacttaggcaacctatttactttttactttttactcagtcacttcactgaattatctttaccatgtctaagagtttttccattggttctcatgaactttttatttatacagttatattttgtgcaaacaatggtaatttcctttcttttttaatatgcacagttttaatttccttctcttatcgaatggtatgttctagcatttaatttcatcactatctgattcattccctgttctcatttctaattttgttttgttcttcttttcttgcttagtttaatcaacaatctaatttttatttcaaaacttttgatttatttaatagctctaacatcattctgttttcgaatgcattgattcttgtgtttatgattttattaacttgttccttttgcttttttgttcgtattttattgattttttttctagttcttttagttggatgcttatgtcatttattttcatcctttcttgttatttatatacgtatgtgtacaagacttaaaatgtctcctgagcattgcttttaacattttacctaggttctactctcatatataacttttgtatatgttctccagtcaccgttttggtttcctttgtgattcaagagtgaattcttggtcataaatcctgataagttctaactttgtggggaaatatttaatgaacttctctttgtgacctaacatgtcttcaagattggcaattttttccttgattgccgggaaggaatatgaattatctgtccttaggttacagaattaggtaaagtacaaatagatctaactatgttgtttaaatcttcattatttttgcttttgatgtttaatcaacaatctaattttttatcttaaaactttacatttacttaataggtctaacatgattctgttttcaaatgcattcattcttgtatttacgtttttattaacttgttccttttgctttcctcatgcatattttattggcttttttctagttctttcagttggatgcttatgtcatttattttcatcctttcttattatttacatatgtatgtgtacgagacttaaaatgtctcctgagcattgcttttaacatattacctaggttctacttcatatacaacttttgtaaatgttcttcgatctctggttttgtttcctttgtaattcaagagtgaattcttggtcataaatcctgataagttataactttgtggggaaatatttaatgaacttctctttgtgacctagcatgtcttcaagattggcatttttttcctcagttgctgggaaggaaggtcaattatctgtccttaggttatagaattaggtaaagtacaaatagatataactatgttgtttaaatcttcattatttttctttcgttgtatactgggtcagtcatggactgagagatgtgaattgaagtccctcactattgacatacttctgcctatttaaaaaattcttgtaggtttcactttattaaatttgatgtaatattttcatcgtgtgcacatattcatacctcttacatgtttattgctgagtatatgcttactcatcataaagggccatgctttgtcacaggaatgctttctaccctgttttaactgtgtctgctactcagaacatggccatggctttcctttccaatttgcctgatttgcctttccacattattaatatttgatatttgtaaatactttaaaacttaccacaacaatgtatagttaagtttgtggtccaaagggaggcatatgtagcacattcacattgtaaatatcatattttacgttattctttctctttatatctttattttgcattttcccctctttttctgtgtaagtgtgtgcaatatttcttttcataatatgaaaatgtgggatgtttttagtttttataatggctaactctgtaattacaaattgatataatacaggtttttttgtttgtttgtttgtttgtttgttttattttattattttttttgagacagggtctttctctgtcccccaggctggggtgccgtggtgcaactgtggctcactacagcctcaaactcccgggctcaagcaatcctcccgcttcagcctcctgagtagctgggaccacaggcatgtgccaccacacctgactaactttgtatattttggtagagatggagtttcaccatactgcccaggctggtctcgaactcctaggctcaagcaatcctcccgccttggctttccgaagtgctgaggttacaggtgtgagctaccatgcgcagccagccttcttctttttccaaatacagtgtcaacttcccactatggccagagatgaaattataaagtattctaagtatgccactccccaaattaacttggttatatttttattggtttttccagtatttatatcttgattaattgatttatcaccattaaagaatctatttgattcctgtataggcatccctctatcccttatctctcatcttctttgtcctatggacttttgttacagtaattctaaattgccatgatttacaattgatttctgtacagtaatttccacagatattttactcctaatactatagttaaatagaataaatgtggagagacaatactttgctatggttttgtgatttttcatcattttattatgaaaagtcataaatatatagaaatatgaaaataattgtattgtgagcacccattaaccattacctggattgtacaatcaatatatgcaatatttgctttacctattagctatccatttagtgacactcatcattccattgtattcacaataatttttgtattgtgtattcacaataatttttgtattattgtgaagtgtattgcacttcacaataattttcagatagcaatcgactttacctttgaacacgttagcatacatatcgttagctagagttcaatattagtggtctttcctcattttctcattagctaattttttttctgattgtcaggaagattttacagcccctgcaattcctgcctattttcccatttgaaaatgtgacctgtaatcatataattaaatgttattctgcctgggtataacattttgttttcttgagaatttcatagatgttatcccaatagtttcataagtagactgttactgtgagaaaatctgagattggtgtaattttaatttacttttttttaagtgaactctaaaaaattttttttctaattataatttatctacaaaagtccaattaatgaaatactaatttagatacagttcttgctaaatttttaatatcaactattcttagggcattgtgatcattttcatctgcatattcaagccttcttgcaatgatacttctctattatttaaaaaaattatatttaatacttttttctttttcttttcttttattattattatactttaagttttagggtacatgtgcacaatgtgcaggtttgttacatatgtatacatgtgccatgttggtgtgctgcacccattaactcgtcatttagcattaggtatattaatactttttagctcatttatgtgctgctcttccccgagcacaccagttatgcagattttgaatctccttgtcttcttccctgtctctctcccttgaatattttttcctatctatctatttatcatctatctatcatctatcaatccatcaatctatttatctatcatccatgtcgtttttttgttttgttttgtttgttttttgagagagagcctcactttgttgcccaagctggaatgcagtggggtgatttcagctcactgcaacctccacctcctggattcaaccgatactcctgcctcagcctccccagtagctgggatcacaggtgcatgccaccatgcccagctaatgtttgtatatttacagtagagacggggtttcgctatgttggccaggctggtcttgaactcctgacctcaagtgattcaccagcctcatcctcccaaagtgctgggattacaggtgtgagccaccgtgcctggcttggtttatgtttctaatgcaattcttcctcttctggacagtgtctagtttctttgggttgattacaatatggcaatcagtttttttattttttaattccctttttttctttcaagtattctgatagcttatattccatctttctctcgtctgaacttcatcttttacctctgctctgagctatttgattgcttcattcagttcttttcattcatgaccatacatttcgttcaaatgattcgtcggctcaataactactttttctggtggagcattatgttccacttgtttttccagtgcttctctgaacctggtcttacattacattgatatcaatcccatgctgggagcttcttgatctatgtctcgctttttggtggaagtcttcctagatcaggtacttgcaaaaggtttatttggagcggggaaagcataactagattagtaggagtcatcccccatttacagggaagtaccttctgatatcaggttacatttctgtgtgagttgttccacttcacttctctccagcctaccaaggtcagcaggttgtgcgcagtttgtgattctgaggacctctgcctcacccattcttgtggacgtcgagatagaatttatctggccctgcctctcctactattttatggtgccacacactcgaaaggagaggtacccatcaccaaagtcatcaccaaagtctgtgattaagccattggtagtgtttcctctctgtatatttaccctactttgagaagaatgcttctgcctgagatactgcagagaccttcttgtggcgacttctacattttcatttgatttcccttgatttgggaaggtgatttgcatgtacggaaatcacttagtttttttcaaagatgaattgtataaactctgcagctattaaacacttccccgtgtgaactctttgcccatccttcctcttcattctagaaggattcctttctgttctatatagtgcctttacattgttatattgctttttctgctttagtcatacattttttaaagtgggaaaattgggtaattgaaaattgagtgtttcagagtggtcttcacagaaaactttcacagatatggtttcatttcatccttttgacaatccttcaatttgggcattgtaatcttcatttcacagaagaacaaaagaaactcagagcacatgttatggctaaagccacatacgaacacgtgactaggctgagtttctgacaccttcattgtttcattatactgcctttcataactgggaatgaaacctgaacagtcccctgaacatggtgagagtttagacatttgatatagattagaaaaaagagaaaattgccctgattcatcatgagcagactttgccatggtgacagactgtctaattggcttatatatatctttctgtttcagtccgtaagtttgctcattaggatgtgtttttctttatcctacctaggcaggtatttggggtgtactcgtgaaccttgttcccatgttagggccctgttggagagtagaatagtttcatgtgccaggcataggcccagccaaggacatatcccctgcttcgatgtacttacacacaatggatgcctttgctgattcaagggccaaggctcttacttccttttagtcttgttagtgactaattagttcatctcctgagcttttcagttagaatacttttacaggagggcagggactgtttgtactttatataacctcagtgcttcaagcatttcaatataaatgtttcttaattgaatattatctgttcttaaaagaagagttgtagcactttgatgttctacttttgtttatctcttgtcaacagcagcaaatatttattggcattagtactaagcaatgctcagatggatggtggaattgtcatcctaaggtgttggatcaggacatgggcagtggtccccaaggatagctggaaaatcgttgagggtaattgaagctttctgggatgttttgcaaatgcaaaggaaaacatgcattttgttgttgcaggcgttttgtgcattgaggacataaagtcatttgcctgtcatagtgcagaatctgtcaggattgcagctgtcagcttgtcagtgtgacctttcctagtgtgacataccatggaattttatgtcatgctaggacaatatgacaggactgtgcattgctttttcagtagatctctccatccttatcttctcaagaaagaatacattctgaaagagataagggagtacgcttatcacatattaatcctataaagtcagaaagcagataaaaaggttatacattaagcttgattttatgcagtaattcacataagtgtgtgatattacttatgtgtgtttgcatgtatgtgtagatatacacatatatctcacacacacacacacacacacacacacacacacacacacacacacacacacaaagtctttaaaattcaggaaccagagaggcagccatgtttctgtctagcagcaggcaaagaaagactggaaatatccaaactcattttaaatgccattctgaacttaatatggaattacctaattatgtctaattcaacaactgaagcataaactactgatttcagcccaagccagaattttacagatttccctattttcctgtatagaatataacacttggcacaaatcctagatcacatcttctttgcagctattaccaaggctctatgagccttggtagagaatggtttgcatcatgcactaaaaaaaaagcaactaaatcctaacattttgagtttctttttttctattggtagggaactctcacagacgttgatatcacataacctagtagcatcctgcttgctagagcatgagtgctgtattgtatgctttatgaaatagaatatagaagtttgcttgatactatttggcaggtaatatattttatactttgtataatgctaataagttattagagtaactgttgaaactaaactttcaattgaaaaatgtttacgagcaaaacaagaattgcatacgatatcactctttaacttcttaacttcactaaatatcataaacctctttatgtcccgatgcacacgtttcctgaaccagcttgtaaaaggtgtaattgttcagaaatcagatttgaatactcagttttttatttcacaagttagattgatgcatttacagagtattttccaggatacctccaggatacctgtgtgtgtgtgtgtgtgtgtgtgtgtgtgtaatatagtgtatacatagtatgtatatactattatagatattatatagtgctctgtatctatatatagtacatatagtctgtgtatctatacagtgttctgtatttttcattggatgtatttttctccacatttaatcatcttgattttgtgtataatgggtaggaaaaattatttttgaaattctcctggttgaggggcctatcggtacttcatagtcccagggaggtaatcaattggaatctttcagcagtagcgctgactgttgagggacccttctgtcataaccagtatccacagtgaactgggaatacctccttaaacccatttatgctggaggttgcaatttttttgaatttttgcgtcagtgaaaaatcagactttgatgatgaccttgagcagtaggatataaataactcccacatgtttagtgttccaataatggaacacttgggtattgcattgatgttaataatccaaatagtttctggcgtgcacacatcctccagccaccctgaaattcgaaccctagtgatttgatttatttgtacacttctaggcagtccaccatgtgttctggaaacagttgcggctaaattactatcattgttgtgctttggcacatggatgtttgatgcaactgagaaagcaattttaatggaatttattctgacagctatatatacctggtgcagacttaatatgacatgatacgagccccacacacctaattgtgtaggattcttatgaatacatcacatggatacaaaaccaagaaacactcaattatctcatgtgtttgatgtggaaatttctttactaccccaagtctgttacctttcataaccattaaagcagccccactaatctttttataaagatttatgtttcattcaaaaagaagggatgtctaagccagtagaaagtgccatggggagctgggccataatagtaagtgctctcctttcattaaaatacctcctgttcttttttataaatgctggagactggccttctcttacattgtggccctttggagtctgaacaacttaacctcagccatcaacaggcgatccaaattccagtggggcagagcctctggatgatggggctgaatgcccagagatgacttgcaaagcatctcggaaatctttggccttcctgcccccaactccactgacgtgcatgcttatttgtaggcctgcccttgaaggacaaggcatacagattttcatccatcctggaatggtccagccaactggccagaatgcccaccaacagaacatatcttgagcaggagggtaggtgacctgcagagattcacacgtttataaaataagattgaaatcctaagatgcaaaaaagaaacaaatagtactgttcaatcgttactggaaattttacatatgcgttccttagtaagaagcttcctatacatttcttttcagagatatagtaatgtctgtcattaaaaagcagcaacaacaacaaaacttacctttgataaagtctcagtatattcaataacaatcatatgtaacatagaccctgtgagccctgatggcttagataaacttcatgcctatgaaagataaaaatctcaaacatttgcaagcaaattttatttctgaattaaaacctatgttgtaggctgtgaatatgggcaattcatcaaatgttctgaagtcattgtccatgaatcctaaatcaagggctttatccctgtaaatatttttttccaaggccatcaagcttgtgtttctgggtaaataacattttttttcattactgaaagcaaagtgctgagtttcatgtagttgtgaatgaattaataagattgtggccagaatttgaaggcaaacagtggtacatcaaaaacatgtgggatctattttcaagtgtcagccaggactagaacattttaaaaatctgtacttgacggcctcttcagcaaactaaaagtgatttgttctgctggttttcccagtatcaaagcaagcaggaatcttcagatgtattattttatgttacgttgtttggtttggtttataaaggtgctattgtgccatggtgtgaagaaaatttttttttaaatgagtaccagagtaacttgttaaccatttcctgtatagctttctaagacttttcactgcatattgacatttatgttgatgtgtatggagaaatgtcactgaacatttcattgagtttttctcctgtgtatcccaaggcagaactttcttaaaagaaacacaaaaaatcaaatgtaacatattaaattttatttctgcctttgaagaaatattttaattggcttatgtattgtggatttggccatcaactattataatgtatagaattaattaaaaataggcttaaatcaaatatattaatgtaattgtgaaaattcctatgaggtacagtatgcctaatctttattaagaaatttaagactgtttcatcaaagaaactgaagaagtttagaagtaaaaaagatatatagatgttagctcttctgattaccttggctcaatgttttcatgcttttatcttcaacaaaaactgccaccagaagaacacaggcataagtcatatgatgcagcagaactagcttttaaaataactgcttgattactgtttagaatatagcattagacaatacatcatagatgactcctgaaatcacttttttggtcacacatcaacatctgtgggaggtacaagtttattttgatttctaaaaagtgaatgtaataactggatgttttcttttcatctttcatttctgagaatacaaggatacggattagtgtcatgcatttacaatttcacattgtgggatgtacagctcttacaggtgaggaatatacttgagaaatagtcatgtatataaaaatattgtgatagaatgatgctcccccaccaaagatgcctaacatcctaattcccaaaacttgtgttatgttacattccatgggaaaagggaagtaagggtgcagctgcagttaaatgaccttgaggtagagagtttatcctctattatccaggtgggcccaaactaatcatatgcatccttaaaggcagaagacctttttcagacatagtcagagggaggcgtgactacagaagatggccggagagagtctatggtgctgaacttgaagatggggaaaagggccacaagccaagaaatttcggcagcctctgaaagctggaaaaggaataataataataattttctcttcagaggcttctgtataaatgcagtcctgcccaccttcatttagttcagtgagactcaagttcaactcctaaccaccaaaagtataagatataaataaatgtgtgttgttttaaaccactaagtttgtggcagtttgttatagcagcaacaagaaaacaaaataaatatgaacaagatttagccttttcaccctccatccagagacaaaactctcataattatatttttgaattgattttgtgagaatatactcctaaaaacaaaagaaatagattttgtttgcagcatacattaaagtactccagagaaatcagagagccagtagaagattagataaagtagatagataaatagattgatttattatgataaatattattgatttattattgatttattatagataaatagattgattattatttattaggaaggtcaagcagtcccatgatcatttccctacaagctgaaccaggaaagctggtggtgcgagtcagcctgagtctcaagatttgagaaccaggggacccagtggtataattcccagtccaagttccagtgcttgagaactggggggccactagtgtaagtcctagagtccaaatgtcagagaaccaggagctgcgatgtccattgcaggaggagacagatgttctagctcaagaagagagaatgaactcacccttcctctatgtttttgttctatttgggccttcattggattggatggtgtgtgcctacgttgctgagggccatcttgtttactcagcctactgatttaaatgctgatttcttccaaaaacatcctcgcttcacagacacatccagaattaatgtttcaccagctatctgggcatcccttagccagtcaagttgacacacacaaaatcatcacacacaataaacagactataaaacacagttgatttccatgttgacctattgagggaagttagcctttatattgaattttattcaacatgtacaagaaatgcttaattttattaggctaatattataacaactgtagaaataaatatctaattgatcaaaaatgccctttagcaaagtaaattggtcttgaagaatagagcaatcacataaaaatagaacttaaaaattccaagtaggtttgaagttgatcgatataagcatcacgctcctcctcgttatgctgctatattttgtggaacacctaccacagataagctgtctgatttaggagaaaaaaattaatgtcattcaccaccaacagaaatgtgcttattctttcaaaatgattattgttgctgaaagtacaaatgtattgtattcagagttgccataaccacagtaaggagttatgttgcatgatgaatgtgtttttttattagaaaaaccaagaaaaggaaagtttgccatagcatttcgctgtgtaaattagaatcagtctttccattgggtctggaatgtctgaaatactttttttcctaatttgagtaatgttttgtgatcataggttactcttacacactatagccttggatagaggtggttcattgttgtcaaaccataaagcacacgaacagtaatggtacccagaaaagaataaatatttcagaggtttgtgaaaaatacaataagtacattttagtttgttcgtggtctttacttatcctagaccttttacaaccaaaatgagtcatgggacttttagaaggaaattgtcagtgttaggttttgtgatggtaatgcagcaatctccaccttccatgatgcagcccatgcttgggtatgagactgtaaggagtcgagtttcattcacctacatgcccaaccttagcctgattagtaaatcctccaccctgaggaagaaatgttcattggtgggttccctacagtgacccctgtgctgctagggaagggatctcatctgcatcccacaccatctctgccagagcatgacagaataagcacagcacaggaacacaaggaggtgaccaagcgggagggcaccttggcagacaggctacctcatcagtagaggagacattggggtcttcagcatcactcaatcctgtctctatttgtgagtgtaccttgtcatctttgctgcatttggggctggccctgtcattagtatttccccaacaggactttgaaagtcatagggatttatattttcattcttaagtactatttccaataaaagacttctagatttcttagggaacatgtggttgctctactttaagttgaaaacagatatgtttatttaatggtagtcagtagaattatttcctttgaggggagagccataaacctgagttgctgagagtgattcttaaatgaaattcactttgagacttggccagagcctgttctggccattgtaaaccacacactaaacacatttgcttttttgctggttttaatattgacagaaacactgactgggaatcgctcttccttaatgcagttgatccttcacttttttgcagagggggccctgggtgcttaacggaagataaactggaaggatactgagtggggtctgaccagcaaagcactgtatgcagtaaagatttccactgacaacatccaagatgggctgacattccttgtgcccagtggccataggactggacctttccattggattacatgacatggccttagcagagtccacagttgccttgattgatgacaaagtcaagcagacaagccagcaggtcatttcagcatgcaatgaccatcagtatccattatttggactatgtaataatctttcaggaacactgtaaacagtggtattagacctaaataactaatatggttttaataaacctaaattactatttaaacttaaatagcttttaggtattcttgacatcacttcttgatgtctgtcaggtaataagttcccacgtaagaatataaagctaacgtatcctcttaaacctttgtttccaaaaccaagagcattttactgaaactctaatatacaggcaagttgatccctcattaagccatgtgttcatcttaacagatatgcacatatttttctaatacagaaaccagtttcctagactaattgaagatccttgcattgaaggtaatagagtcttattatttgcattcagtgtgaactgtaaaatccaagtcattagagaaaacaagaatatgcttctctttcaaaaaacatcaagcatgttttatatagtcttagttgcaaatttccatagttactatgtagtgaaggttttctgaaggagatgaggattcttcagagcaagggttcagttaactggcatctggaaagaaccaaccttaattctaaatcctaactggattttcagaggccattctgagggtagtagattttatctatgaccttgtgtgccagatgtttcattttatgttctcccttatttacctgaaagtgatgatgggcaagggaggcatatgaaattagctgactaatgataacacgtgatcaactacaggcttcatagctgagataccccaaagggtttaattaggatttcctgccaatctgagatttggaaagtgatttgggataacaaaacaaacacatggaaacagaatgtgatttaaagagacgactcacttaagtcaccagtctccaacagaacagaaccaatgttgcattatcccagagtgaactgagtcacctaacagcccagaggccagcacgcaattaaagcttctgaggtgctgtgatctgaatgctggtgtcaccccagaattcatatgttggaacctaatacccaatgtgataatattaagaggtagagccttttgggaagtgattaagacatgagaactccactctcatgaatgggattagtgctctcataacagatgttgaaggggctgccttgtctcttccaccatgtgaggatacagagagaaagtaccatcctggaagcacagaatatgccctcaccagacacagaatctcctggggccttattcttagattccccaggctccagaaccatattttgttatagcagcccaaatggactaaacagaaaacatagacaatgtagggcaagcgtaggtcagtgatagagaagctttgaagcaggaaggaagaatgtgggatggacagtgagtgaggcacatgtagggaatggaggtagacagcatcatccagggtacattacaaatcccaccatcatatgtaatctgccattgttcagtgtgaacagtcactgagcatcagaagaccttgatcctattcccttctctactttggagcaagttacaacatcatgggcctcagtgttctcatctaccagataagaggatcaggcccagataattgtatcagttcttattcattttgtaaatattttatgctatgccccagtttttaaaaatagaatatgtattagtcagccattactgcaataatgcagtgtaacaaatagcccctgaatctaaaagcatctctctctcttgctcatgggtgctccaggtggctggatattggctatgctcaaccggtttaggttggacttgcctccaggtaccagattggtccagattggccctacttgattctcctctcccttatgctagtaagtatgtggggttttctcttctcaggcagatcacagcagtgtcagagacaagccaagccacacaaaaacatttaaaacctctgttccagacattctgctatcacgaccttggctgccagttacatgtcggactccaaagtcaacagccctgacaagtgtacacctcataccctcagggaatggcaaacagtgggaaaaatgatagattggccacaatctagtatcctgagtctccagttttagttatgaatcctctcttgaacatgttttagaatatttcaaagttgagaaaggaaagtagcccctattaatgctggaaagacaaggagggaaagaaaagtaaaagcagcagtttttcctctattattgcaccttattccttgtcttaaggaaatccccattttgcacaagattaggttatttaagtgtttttcttcacttactttcttctaaattattggtgaaaatactaagttcacagccagaaagcttgacataaatgcctgtttgtcaactttgtaaagtggataggaatacaaatatgatgtagagctgctgtaaatctggtagaataattaaaactttaaaatatttcatttcatgtcacttgtaatcactacaactgtaggaatgatgtaaagcagagaaaataggacccatcttacatctgctagtgtttgttatgaggacattacctttcctttacttttttaaaaatttcaccagtgaaattatattgaccaaatgaaaactcatagattactaatgtgaatttactatttaaaaataatgttgaactcatattggacataacaagtgatgatataaacctagattttattttgatcatgaaataacctagtcatgaggagtaggactgtggaaacctggcttccccagcaggaacacagacgggaacacagaccaccatgaatggaatcctgtaatccatctgcagcttcaactctttaactcacaatgaagccatatgaacattctctttaattaagagatgttacagttttgtgagatacaaaatactaccgaaataaagaaggatttcaacgtctttattgacactctactgcagcataaatggatctaccaagtagggtacattatgcagatacatgcccatagcaatacaaatgttaattaaaaccttgtttaagatttctattttggaatgagttagcatttcatgctggtaaaagaaattgattaagcgaattacataaattagccaatactcagaagatccacatagccttcctgtcactaatatagatttttatcaacacgatatgatccacaggtgtgagagcaaacataacaaaggaaataactaagaaatctgtagtggtgatttctgcatctcgggaacttatcatctaatactttataacaagaacagttatactctctcctctgctattttgtatgcttttgtttcatgtccatccacacatgcatacacatgaacacatgtaccggggaagagagacaaggttcacagatgtatcctgtattatttccttcattaagggggcatgttccagttggagagtctaaacattaataaaaaattaactcggccaggcatggtggctcacgtctgtaatcccagcactttgggaggccgaggcgggcagatcatgaggtcaggagttcgggaccagcccggccaatatggtgaaaccccgtctttactgaaaatacaaaaatttgccgagcgtgatggtgtgctcccagctattcaggaggctgaggcagaagaacttcttgaacctgggaggcagaggttgcagtgagccgagatcgtgccactgcactccggcctgggtgacagagcgagacccaatctcaccaaaaaaaaaaaaaaaaacaaaaaaaaaattaggggtcttaatttgtatcatattctttttataaattattgaatacattggtagtacatgtttattattaaaaggtagcagataccttttaaatataaaaaaattaaatttaaaaatatttaaatttaaaaaactagtaaattttaaaaaataaaatcactctgatgtcaccatgctaagatggatactgtgaccattttgacctcaacatccagacttctctctacacatatgcatgtaaatgtatatataagttatatacacagatattttacatatataaacttaaacaggattgtgcagtgcctaacattttataatgtactctttgattcaacaatatatgatgaattactttctgtactaagaaacatttttagggaaactcattctttcagcaaatatgctcggtttctttcaatatacccccttggatgaagttgtaattgtttggttgtcttcataacctctaccctctggatctataatctagaagagaagataaacattagttaagtaaacaaacaagtggatttcttacaaatagtaagaaatattctgaaagcaaaataaacagtgtgcaatgaaaaagagcagtggaagaatagaagcatgaggaggaaatggagatgagttgccaacaaactcagaaatgattccatcatggggtcccatggcacaaggatcctgagcagagggcattggtcagcgagtagatgggaaaagatgcatgcacagaagcccagtgagctaagaaggaaccagagaaataagtctggggttcatccagggcttggtagggcaggtcaagggtttaaattttatcctaaagtttgagtatcttttagacaagagaaggaaatgatctatgtttggaaccagaagttcattgatgattttggcaaaaggatgcttagaagaagtaggagagaggtagccaatttgaagggtgaatggtttcataaatttatggtgagggatctgccttgttaatccttctcatattgtggaatatttagcatctattgtctttggtaccaaaacaaaactgaagagaatgatggtaaatatctatatcttggataactaagtcacaatgaataatcctgcttgttagaggcacatgacaactcacacatggtcaacgctctatgcttattcggcctccagggagctagaccaagggaaagacttacaagaagactacaggatggggttgaggggtgaatttcagggggctaaataaacaacaaggctctgtcttcttgggtcatgtcttccttggtcggctctcaagaaagatgatcctggcacttcctccttcttggaacctgggctctagggtctagatctggtctacttggcactcagagacagacactcccttttccttcatattctatgtgtttgcctcagggtttaccatttcttgtccacagactagtagaaactgaagatccaactgagtaagcttggggttgggggaaagaagggctgaataggtcccatagcctgcatccagtgcagaccccaaacttgcctgaagtccattaagagagtgtcctcaaagctccaggtggtccattctaataacattgatgataactgtattaataataggactagctaatacacactgtaagtgctgttcaatttacatatgtcaactcattccatccactcagcaacctcatgtggtataggtcctgtcatatggggtagccctgaggctacgttgctcagtgtcacacacagccaagactcatgtcacacacagccaagactcagacctgggcctttggacttcggagtctttaacatttgtgattacccttcttctatactgtctctttccgtgtctgtaagtgctgttcagtttccacatgtcaactcattccatccactcagcaacctcatgtggtataggtcctgtcatatggggtagccctgaggctacgttgctcagtgtcacacacagccaagactcatgtcacacacagccaagactcagacctgggcctttggacttcggagtctttaacatttgtgattacccttcttctatactgtctctttccgtgtctgtaagtgctgttcagtttccacatgtcaactcattccatccactcagcaacctcatgtggtataggtcctgccatatggggtagccctgaggctgtgttgctcagtgtcacacacagccaagactcaggcctgagcctttggactttggagcctttaacatttgtgattacccttcttctatactgtctccttccatgtgtctctctggagaactgccactaggttgaacaatgagtcagatgttcaaagggctagcatcatggatgctgatcacccaaatgctatctcaccatggccactgacatcattaatgtgcagatacatgttcctacaactcattcagaagacccaggttgctttacagtcacaaaatacttttttgtaaatactgtaaattgttgaggacattgatcctccctgatttggactgaggcacagagcattgggaaggggtccagaaggtgatatggtttggctatattcacacccaaatttcatcttgaattcccatgtgttgtgggagggacctggtgggaggtaatttaattatgggggcaggtcttttccatgctgttctcgtgatcttgtgatagtgaataagtctcatgagatctgatggttttgtaagggggtgtttccctgcacaagctctctttgcctgctgccatccatgtaagacatgacttgctcctccttgcctgccatcataactgtgagggctccccagccacgtggaactgtgagtaaattaaatctctttttcttcccagtcttgagtatgtctttatcagcattgtaaaagcagactaatacagaaggaagcattgggctttagcatggctaggcagctccaatgtgtgcatgggactcagatctcagccacttctgtctgaggttccgaatacatgcttcctaagtactcagtgctgaattctttctgttcaaacatctgaagtgttgctagtcctacctttatagaactatgtttcacttaaatctgttctacctttaacttgactttctgacttcactccagttccactgtattaataactgaacagtgggatccaggcctgatctgcactggaataacatttttgcacagggatcttttaaaagtgatttaagttctgattctgttttgcctgtgtatatgttgtggaactaatattaactaatttattgagtactatttgcaagacctatcatagctgttttgtgtctagtttctcccttaatcctcacaacagctccatgatacaggaggtaatattaatattcccattttggaaatgagtaagctaggacccagagaggttcagcaatttgcctaaatatgcacagctaatgggtggtaaacagggatgttgcttgcacctatgacaatggtgcaatagaaaagggtacttctactttatgatacctcactttcatctgctgaaaaattattgaaatatactggttttttaagaacatgccactctatggctaccttccagaaaaaaaaaattgtaaaatttataaatctaagatgtcgatattggcagtgtgcttggcatcccctagagtgtgtaggggtgaaatctgtgaatccaactccaggaaccaagctctcagcatgtatgttacagtgcctcgtgagagatgaaaggtctgctgtttttcaaaaggtgccagaagacaccctcattttggagagcaaaaataaattatctcaatcagtcctcattccttatgttgttagcatcaaaagaaagctttttctcgggccaacatggtagcttttactcagagacactgtgtgcctattaccagcaatgataggtccaacaactaaatgttgatgagaccttggaccttgaggttggccaaggccgtgctatgattgcaagattcaatttggtgccatggtttgtgaggcttacaaaagtgtataatgttcatttgctttatgtcggattattgcactttctcatttatttaactccttcacttaccactcattcattcattcatcaacccaatcattgtttgaaagcctactgtatatcaggaactgttctagacctccaagataccaagattaacataacacatgatcgttgcatctatggagtttatattctagaattgttttactttggacaatatcacaagctctattttattgagtgtgatcattaaattaggataccagatcttagggttgaaaagggtctcaaaaattatctcatctccttcattttaagctcaatgacaagtggcatcctcaaggtcacacagtctatggcagaatacagactcgatgctgtgtccccagactcctggtcctgggtctgctgctactgccagaaacttcattttaatcaggtgttggtgtcagcatacacctggtggcgagcaagaaggcagcttcaaggtcaatacagggtaggacatagggtcagactgagacctgtgaggctatgagatgaacattgctgcaagccaaatctgagagcttggcctcaagggcctgactgccagtgccccagttctggctcttcttctttttttcttttgtttttttgagactaagtttcactctttttgcccaggttggagtgcagtggcaggatctcggctcactgcaacctctgcctcccaggttccagtaattctctgcctcagcctcccgagtagctgggattacaggtgcccaccaccacgcctggctaatttttgtatttttagtagtgacggggtctcaccatgtgggccaggctggtctcgaactcccaacctcgagtgatctgcctgtcttggcctcccaaagtgcagggattacaggtgtgagccaccacccctggctggctcttcttttaaggtctgtgaacttgagtaagttatttaacctctctgttcctcaatgcctcccttgcaaaatagagataatcataaagctggtctcacagggttttcactaagattatgtaattgctcatgggaatcttcatacttctcccatggttggtgcttggtgaagcttggctattgttattactattattagtagtagtattgcctctgtgactctgtggacaccttggtggagccccgagcttagtttcttgaatcccccttgtgattcttagagtggcaattcccacagcaagtctccccttgcttgaaaatggtcctgaatgtgacccaaacagtgaacatgtcacagagcctgtctacaccccttctgaagaaagccgcctgtaggtcatccatcaaaataatcatttaatttcacattcctgattttgatccttttcaggaatcctgaaagtgaattcctaccttttcagccaaatgtaatctacttcctgtgttttcagccaccacatctgattataggtatgtggcatatctgcagtaagtgtaacacactatttcccaaaaagaggccataactcacatgcagaaccaaatccttttggaaaacagtatatgcccttcccagaaacccaaaatttacaataacttattaaacaccctggagggtactgaggtaataaaatctaaattctataaattgattgtttcagcaagaaacaggcttccaagctggcttcatgcatgcaggaactctatcatcccaaaagactgtgctcttagaaggacccagtgcttgacttaatgcgctgctgttttcgtcttgaaattcttaaccattttttaacgagggcggcctagtttcacttggcgagtccttcaagctttgtagctgttcctgacacccctcatcatatcccacagaactggtgttctgccaaacaagtctcaggtgagacccctgttgtctgttttctgtcatctgggtcaataagagacaaactcagtggagagttaagaatctatcttaattgttaaaaatatgcaccagatttcctaatctaaatgtatgtgcacacaccactagatgccagcatgaaccagagctgctgaattcctgttcagagagaattcagctcagccttgttttgagaagttctaggttcttcccccagaggactatgatggggcaacttaaacccgaaaatactgttcaagtgtaatttgtgtaaactaaccatctcagggggaaatttttccatattaatctttgtgtaatttctgaattataaaactatttttagatgaagaaatacatcactacaattgatacagagacactttaatttaattggcacaaaagtatgttaaaaatattccacagtacagatgctccctgacttatgatggggttatgtcctgataaactcatcctaaattgaaaatatcttaagctgaaaatgcatttaatatgcctaacatattgaacatcatacttagcctacctcaaacactcagaatgcccacattagcctacagttgggcaaaatcatctaacaagtccgtcttgtaaaatgtgttgaatgtctcatggttgtttttcttgattccatggctgactgggagctgtggcaccctgctgctgctcagcatcatgagagggtatcatatcacatatcgctagcctgggaaaagatcaaaattcaaagtatggtttctattgaatgggtatcacttttgcaccagtgtaaagtgcaaaaatcctaagtcaaaccatcggacaggaactgtctgtataggtaaagggataggcatagagatcagtgaaactgaatagagaacccagaaatagacccacacaaatatgctcagctgatttttgacaaaggtacaaaagcaattcaaaggagggatgatagtcttgtttccataaaacagtacaagagcaattggatatgcataggcaaagaaatgaaccttcacctaaatctcatagcttttttttttttttggtagatacagtttttaaatttgtattatttattaatttttaaactttcatttttaggttcaggggtacatgttcaggtttgttataaaggtaaacttgtgtcaccagggtttgacataaagattatacaaaaattcactcagaatggatcccaggcttaaatctgaaatgtaaaactataaaatttgttgttttgtttgctgcataataccaactaaattaaacaaacattagagaagttgaaagaatgcaaggatttaataaatcatctagcaacaaggctgcactttgagcagctgcgggctcacaggattttcctttaagccaagaggattccgcttggcagctgcggggcaaggccactggtgtgccacgccacctcacaccgcagccaccagacttcagaactggaaaagggtgattccggggtaatctctgccacctcctgcctaaggagagatcttgtccgctccctaccatttgtctatcactgatcgattccattattggaaaactttctagagcacttgttggggacaatgtaggtctttcaggataggatggcctgtctcaaaaggtcatcctagggccatgttctttcttcgtttcctacttgtcccactcaacaaacaaggctaattgtggctacctctcaaggctgtgaggaaataatcattcatagctgaaatgggtcttgtagatatcagtgattgtacattctccccaatatctggatttagtgtctaatcgggtgtttttttgtgacacatgttgtattgataatgatcaatataggtttattgagaataacaaataattacacaaattcaaaaattattttccttcattatacacagggcatatcaggactgctttttgcaattataattgaggtgctgctgcattattttgtttaattatttccacctgatggcctgattaggaaaattgctcaccttgttttcctagcataatgcaccattatgagaagcaattactgcagcctgtgtccccagcccccaggctgagctaccatcctacagtggctaccatcctgtagtgtgcatggtcttgccagcgtccagatagagtttgagttcagccatttgattctaagcctaaattcaaataatctgtttttcaagaaagggttttgtttaactctaagacactggaaaggtgatgtgtgatttctcatttgctgatgtttgacgccgttgttggcgtctccgtgttggcatgagcacactgctctctgcctccatgttgtgtgttcacacctgctctggctgtacaagctgaaagggttaaacgtatcctgtcctggtggactttgtgtggcattaatgtttgagaataagtgtgctctgccaccacgtgatcatgtgtgtgtaaacatgattaaaaggaaaatggtgatgacaaggctggtaaggaaagttgtggaactgcattaggacaggcagccatgcgagggccagaatgaaatacccagtttggaagaagaaaggcggtctagatgccccttggaagtcactggcccttcccaggtgaaaccatgtggtgtggactccagctgcctcaggtgacatcgcccaacgcaggtgatattatccacttcagatgacatcgtccacttcaggtgaaatcacctacctcatgtaacatcatctacctcaggtgacattaaccagctcaggtgatatcttctacctcagatgatgtcatcacctcaggtgacctcatccaactcaggtgacctcatccaactcaggtgacatcatctacctcaggtgacatcatccacttcaggtgatatcatctacctcaggtgacatccacctcagatgatgtcacctatttcaagtgatgtcatccacttcaggtgacattgtgcagtctcttgctagccatttccctaaactggaagagagatagaaaaaaataaatcctacctctgccatccgccaacagtgtgaacaaatccaactctctccaagcttttgttttcattccttaataattgaattataggaaaatcatcttcaaagaaaaatgcagtcccgtgcaggggttggagatggggccagtcaaagcagaaggagcccatatgaacaggcagatgttatgctttctgtgttggtcccgtgcagctggtgcctgcctgctgcaggtgctctttttttttttttttttttttagacggagtcttactctgtcacccaagctgagtgcagtggcatgatctcagctcactgcagtctccacctcccgagttcaagcaattcttctgcctcagcctcccgcgtagctgggactacctaccatgcccggctaattttttgtatttttagtagagacagggtttcaccgtgttggccaggatggtctctatcttctgacctcgtgattcacccacctcagcctctcaaagtgctgggattacaggcgtgagctaccatgcccggctcattttgacaggtatattaatgaatgaagaagaaatgtgactgattttttttgtatctgtaaattgcttataatttgaaacagatagaaaatggttacaacagaaatgttggctttcacagctgggaaagaagaacaaacgagaagcgatgggtcaacctggttaagagagtaggtttcaggctcagacttccccaggtgcaaacccagctcagctaccgtggaacctgggcacatgacttcaccctctgggcctcagtttcctcacctgtatgacagagattatctcacctaagccatataattgctttgagatttagtaagttgatgcatgtcaaaatgaagggcactgactacttttttcctttactatatctattcatagctcatcttctggcttcgttgatgaaaaggggcatctattttagggcaagataattagctgtgtcctatatgataggctgaataatgccccattcaccaaagatgttgaatccgaagcactaggaacctgtgaatgttactttacgtgggaaaaaggactttatagatgtgattaaattgaggatctttggaagtggggaggatatcctagagtgtttgagtggcatctaaaggtaaccccaagggtcctcataagacagaggctggagggccgaagtgggaggtggtggtgtgaggaaggaagtggagatctgagtgatggccaggagctgagaaacaccgcagcctctggaaggtggaagaggcaaggaacagattctccactgaagcctctggaaaaaacagccttgccaacaccttgattttagccttttgactatcagaagaagaagatatttatttatttatttatatatttattttttattattatttttgaggcagagtctcatgctgttgcccggactgaagtgcaatggcacgatctcggctcactgcaacctcctgggttcaagcaattctcctgcctcagcctcccaagtagctgaaattacaggcacccaccaccatgcctagcgaatttttttgtattttttaatagagccggggtttcactatgttggccaggctagtctcaaactcctgacctcaggtgacctgcccgccttggcctcccaaagtgctgggactacaggcataagccaccacacctggccagaagaatacatttataagagaatcagtttctattgctttaagccactaagttggtggcaatccattacaatagccacaagaaactagtacggttgactctagaaaaatgcagcagttggggtactgactgctcaggcagccagaaatctgcatataacattttactccccaaaacttcaatatagtagcctactgctgactggaagccttactgataaacagttgattgacatattttttgcattatatattttagatactgtcctcttacaataatcttgagaaatgaacacattattcagaaaatcataaggaataaaaaaatatgcttactattcattaggtggaagtggatcatcataaaggtcttcgtcttcatcatcttcacattgagtaggctgaggagtcataaaggtctccgtcttcatcgtcttcacattgagtaggctgaggagtcataaaggtctttgtcctcatcgtcttcacattgagtagttcattaggtggaagtggatcatcataaaggtctttgtccttgttttcacattgagtaggctgaggtgtcataaaggtctttgtcctcattgtcttcatattgaataggctgaggaggaggaagggggagaaggattcatctcaggaggggcagaggcagaagaaaatttgtgtatcagtgaaactgcagaaacttgggttgttcaggggccagttgtacaccccattacatgagatttcaattagtttagatggaagtttttctgaaaatctttgcataacatcagcccttttaaatgagagataatgaagatgtggcaggataactatttttgttctatttatcttcgcagagattctgtataacatagagatgctccatattctcagactgctttgcttttcgaattgctggttttcatttgtaagattttgcagttgtttttctccctctccagctgtctcagtagcggcttctctctcactgctgcctccacccttaccaccttctagttgtacagctagagaagaagaatgccggtaaagatgtgtgaagcacgtgctgtgtgttctgcctcaagtgcgtcgcacacggtatctcatttgactttcccaaaacctctgtttacagattgtgacaatgaggcccaaagaggcgaagccggcagtaaagctacacaggaggaagatagacaggagtccagcggtagagccagggccctgaaaaccactcttcactgttgtattaattggggttctctagaggacagaactaataggatagatatgtgtgtatatatataggggagtttattacgtattaacttacacaatcataggatctcacaagaggctgtctgcaagctgaggagcaaggagagccagttcgagtcccaaaactgaagagcttggagtctaatgttcgagagcaggaagcatccagccagggagaaagatgtaagctgagaggctaggccagtccttgttttcatgtttttctgcctgcttaatatttgctggcagctgattagattgtgcccaacaaattaagggtgggtctgccttccgcagcccactgcctcaaatgttaatctcctttgtcaacaccctcacagacacacccaggatcaatactttgtatccttcaatccaatcaagttgacactcagtattaaccatcacagctgtctctacatcaacttgtagaaaacattgtgttgctaaaactgtacctaaaatagcactgagctaggctgtgagtgaaggtatgaagattaattctccatcaaatgcaatgtgcagagtgctggattttagcaagaggtgacaagcagcgaccagccccctctatgtgtgtgagggtactcttcagattactggatattaggaaaaattattttttgttcatttgtattttacacaaggtcttaatgacttttaatagagttgctctgaaggctcttttcttggtcatttttaaggagatattagtaactttaattcctatgacccaaaattgcattaaggaaagaggtcatgtcttattatattttgcatctcaccatctggaatagcgcccagcatagaaaaaatccagaaagtgtttatcaaataagtaaaataagtaacatattctggagtacttaataatagccagcacttaatgagtacttactgtgtgccaggcagtaagccaggtgctgtttgtttgtattaactcatttaattctctactgacattataaggacctgaagtacaagggcgtttaacaactttccaaactacaagtggcagccctgagctgggagcccaggctatctgggtccacagttcacactttaaaacttgatgcaggctgggcttggtggctcatgcctgtaatcccagcacgttgggaggctgaggcaggtggatcacctgaggtcaggagtttgagaccagcctgaccaacatggagaaactccatctctactaaaaatacaaaaaattagccaggcgtggtggtgcatgcctataaccccagctactcgggaggctgaggcaggagaattgcttgaactcgggagacagaggttgcagtgagccgagatcacgccactgtactccagcctgggcaacaagagtgaaactctgtctccaaaaaaaaaaaagcacaaaaaacttgatacaatactgcctctctaaagtccataaatgtaacatttaaaattatattttgcaaaagacattttgcaaaaaattggaaatctgcagttgtgtttgcaatgaaaaacattattatattttgttggtgccatataataacattgaaaatttggatacaactttaagcaccatgggagagcaaagattatgtcttgttgccagttcatctcccttgcctagcaagctcagagcctcctatacagtatgtactcagtagccatgtgggggctgtcaaaagtgccatgctgcaaggggttacagtgatgcttgaaaaagtacctaaaatgcaaagttttcatacactaatgcaactttcattatattttatattcctaaatgaaaggagtcacatgaaatggtgtgtgtgtgtgtgtgtgtgtgtattaggtcgctgtatgataaaggaagtagaacgatatcatgtcagtggtcagctgggacacaacatgcctatgcccagggcagcggccagctgaaacacacagccccacgacactaaatatggatatttgctctagagggaattagtaaatttgcatatcctgtttggagatagttctgccttctcgtttagtttttgcttgtcttagactctataaaagactcataactgcagttcaacaattgataataaaatagtatttgcagcagtgtgtggtggctcacacctgtaatcccagcacttttggaggctgaggcgggtggattacctgaggttgggagttcgagaccagcctgaccaacatggagaaaccccatctctactgaaaacacaacattagctgggcatggtggtgcatgcctgtaatcccagttactctggaggctgaggcaggagaattgcttggacccgggaggcagaggttgcagtgagacgagattgcaccattgccctccagcctggacaccaagagcaaaactccatcacacacacacacacacacacacacacacacacacacacacacacacacacacacaaagtatttgccctcatggtcacacagttgaggccagcgcctttgttgggagaatgaagagtaagtaaatctcaggtaaaatattagggttaagacagatgagctttggtgttgaacatgccaagcctaaatttcagaaacttaaaggcagattccccttcatagtagatcagactggacctggactgtgaggacagacaagaaagatggagctctcccagagcgaagatgatacagtgtagcacaaagtataatgggtcaaggtctggaagaatttaggatcaaaattcagctgattaatcagtatcatttgggaaattccctttaaaaaaatggggctttctgcctcagtgctgatattcatccagaacacaatacttaactgacctcaactggatgacatcttcaatcaaagctcacaggaagacatagcagcaccaggccacatgcggcaggcagccgtgagcatagcctccctagcttgtgtctggtttggtttgatgcatcaggatgagaatctgcagcattcttccaatgacaaagccaatggggcagcttatcctctccctaactctttccctgtgtttactgtgctgtagagattttgcataaagtgctgcaaagtgggtagcaataagggagctgaggtttcattcacagagggaaggccagggattctgaatgttgactgcaggtgggcattgtgtttggcaaatctcttctacttgaggtctgaccttagccttctagactctgaaaaacgatcctgatactgacccagattggagggggtttggtaattctggttcatggtaacaaagctcccattaacctattgaacaattgagtttgtcagtatatgaatggcccatgcccagggccatggtcagctgggacacatgggttcatgccgagggccatggtcagctgggatacacgggttcatgcccaggacagtgatcagctgggacacacgggttcatgcccaggacagtgatcagctaggacagacagccccattccaatgacagtggtctggtcagctgggacagacaggtccatgaccagagcagcagtcagctgggccacctaggcccctctcctgtatgccctgctcgctgtcttcaaggctcattgcagagagtgctgtggccagaaggttgcttggtgagcctggaatcagaacactcaagcttctggtatctcagacggctgacagcatcaggtcccggggctgacacctagggagctgcttattataccccctgtaataagtattcccacaaatagggatagtacccttgcacactagatttttttttcaaagtgttagccaagtaccaatgaagaaagagcaaatgtgagccaagatgacggtttgggcttgactgaggagaatgactgtggacattgtcctgtgtgtgctgctccaaccccccagcccaaatgacaccattcccattgtcatgtttgctgtggtcactagctggtgctcctaggaagcacacaacaaagcttgctgggcctctttcctaggctccagccctttgagttatgcctctgggaaagtatcttgtacttttcttcatctctcatgtcatagtactctctagaacacttatcttttatgacattgacatctaaaaacaaaataaatagtgaaatgtggcctttgacaactttaatattgccatttacattatgaacctttaacaatttagaatgtataacgagatgacaaatttcctatttctgaaagtagtcacagatgcatagtagtatagacacatagatgccgtgaactgttcccacagcaggcaacgtccactcgtgaaaatgcccatagaccacctcgccaaattactgaatggccaatgaaaggacaaatggagagaaaaggaagcagcacaggttttccaacaaactgtccatggatcttgtaaagtgacaacatttgtgaccattgtaggcagacccatctatgcagcttctgttaactgtgacagcagtcaggctagtttaggaagtctgcctcctgcttagctagccccagggcacaagcccctgacaattgtgcctggctttgctggatacagtccagagtcggtcttttcttccagtgctaccaatggagtagtatggggccagccacaccctctgaccccaatccatgtgtgttcacaggtgcaaatttaacaatcaaacatgagatttggagaagctcttgattgaccagcaagcaaagtgaaatttactgaaaagtttagcttcattgtcctttattctgccccctacaaaaggatattatatatagatagatatccatatatacatagtttattcatgttcacatatataacatatatagttaacatgtgtatgtttatatatgtttatggatacacatgcatgtgtgtgtgtatatacatgctgaaggtggattagaaactataagattggaagtaaatatattctttagaattatactaaaacagaaaaaaagctgtatttttgtttttaagtttatgaaatgaacaaggaagagtttttttttttttttttttttggacaccgagtttcgctctttgttgctcaggctggagttcaagcgattctcctgtatcagcctcctgaacaactgggattacaggcacccgccaccacgcccagctaatttttgtatgtttttttttttaggggggggtaaaaaaattcttatttatctatttattattatactttaagttctaaggtacatgtacacaacgtgcaggtttgttacatatgtatacatgcgccaggttggtgtgctgcacccgttaactcgtcaaccaaacaccgcatgttctcactcataatttttgttatttttagtagagacggggtttcaccatgttggccaggctggtcttgaactcctgacctcaggtgatccacccaccttggcatcccaaagtgctgggattacaggcatgagccaccatgcctggccgggaagagaattttaatctcagctacatcattatcttttttgatcccagcattcctttatgtaacccaaaccttggttctgttttggagttgtagcctcaataactgtaagagattaaacttctgttgtgataatttttgtttgttttttgagatggagtttcactcttgtcacagagagtgcagtggtgcaatcttggctctctgcaacctccaccccccaggttcaagcaatccttgtgcctcagcctccagaatagctgggattacaggcacccatccccatgcccagctaatttttttgtatttttaatagagatgaggagattcaccatgttggccaagctggtctcaaactcctgaacttaagtgatctgcccaccttgtcctcccaaagtgctgggattacatgtgcgactggcctgttgtgataattttttgtggaaacccccaggaaactcacacagcttatttagattaaagataagaaagctatttccagaatataatctattcccagaatgtcatgtcctcaggcatatcgttgttgaacctttgattatattctggaaatagattttttatctttaatctgaagtaaattgtgtgagcttcctggggattccataacatatgaccacaatagaagctgattctctcacagttctggagcttacacctccaaaattcaggtgtctgcagggccatgttctccctgacagttctggagaggtccttgctcacctcctgcggcacctggcgctggctggcaagccttgctcttgttggtttgtattatagacatcacgccagtcacacggctggcttcttccagtgtttttacctcatgttccctctatgggtgtcagtgtctgtctccatatttctccattctataaggacaccacttatattgaactggcacccatcctaatggcctcatttaaatttgattatcactataaagaccttatttccaagtaaagccatgttttgagatactgcaggttaggggtctgccatgaattttggggggacgcaatttatcccatgacttctaaattagaaaataaaagaaatctgttttaaaaggtacgtcatgctgctaggctatctgcaaattaacagtgttccaaatcttggtattgatgtttgcaaaatttaaaaataggacaattcaaattttaccttcctgtttttagaaatcatatttttatattagcttatttattaaagtggaaaaccgatattagctatatataaaaagagaaaggataataggaaagtgaggaaatataaaattttgtttgtaatatttctctaaatgtttatccagcatctccctcttccccacacccctcacagcctccgctcttggatttctgcccattaagactgatagcaggaacatctatgaaatgccattcataattaattttgttacatcactgatcatggcccacatgtgttactggtggatggtatctgagttaccggcagcgaatccatatggctctatagcaacaccaattcttgcctcctcagaggaaagaattcgaccaaggggtataaggcacaaaaagagactgaggcaagtttcagagcaggagtggaagtttattttagacagctttagaacaggaaagaaagggaagtacacttggaagagactgaagcaggcaacttgaaggacaagtgcaatctttaaccttgatcctaggactttgtaggctggcccacttcaggtgtcttgcacccctttcccatgactcttcgcttaggacgagcttcccgcatgcgcagtgccctccttccccttgggaggtgagcatgcgcagtgtgtttaggaagttgtaacaccgtttacatacatgttctcaatctctctctctctcgttgtggataatgagtcagttaaaaattagtaactgtccttgttaatgaaaacctacctacattaatacaatacttctgttcaaaatattcatcgtgactcaaaattttgggaatgaatatatttgctgttaaaatgcttctagatgctcgcatatgccactgcctggcaaagtcagaagagggtacataaattacccaggcgataccttctatgccctctggacttttatgccttgttagtgtctaaggttacagaaaaaagaaatggaacactcgggttgccagggagacatccaagcctgtcaacccctctagctctaatagtgacaaatggtacttattacatcaggactaatttcattggattctgctcagataaagatacttaacctttactgataaaattgtgtcgttataattacttagtaaaagaccttattaggcaatagtattctatgtggatagacgaacattttattgaggttgattacctattacattgatggaatatttgaatgtatgattttctgcaagacctttacttcttggaaaaacctgcagcaaagagattttggttttgtggctgcctcatatggaggaagtttaaaaatgtggtttttgcaagttgttattgaaaatccagaaaaacaacatatacattttttaaaaaatagactttacatgtcaacttttttgttgttgttattgagacggagtctcactctatcacccaggctggagggcagtggcgcgatcttggctcactgcaacctccgcctcctgaattcaagcaattctcctgcctcagcctcctgagtagctggaattataggcatgcaccaccatgaccggctaatttttgtatatatatatttttttttagtagagatggagtttcactatgttggccaatttggtctcaaactcctgacctcaagtgatctgctcacctccgcctcccacagtgctggggttataggagtgagccactgtgctcggccaccaacttttaaaacaaagctttctatccaggcacataaaattaaaatatccaaatatgtcaacgaaccttttagacttttagggtatatgccctcgaaggccaagactggaaataaattacattttgaatgtcagttccatctgactggtagtgactgcctggaatgcagaactgagaaggattctgaagtcttatctgtgctcactagaaaagagtgtagtaattgattagcaatgtctgccatgggcatgagcaggacatgcatcagtggatatgctcataattgccatcccttgtctaagtttatagaaagatagcagttgtgtcaatgaggcattcagtttaaaagagccttttctgtctcctccatatgcattacatgctcagagcctcctcattctcagtttgtcttaggcagggaaaccacagccctataggacatttctcaaggttggctctgtagacctcttctaagcaccctcccctgcagggcacctgggaaaagaaatgtcctctcccaaggagctatttgtttcaacactgtcagagagaaagtcatggagatatttgtcttaaaatccaagtactttttgtttcctttgtccattttggtttccgcctctcaggtgttaattctgctaaaatggtgattgataatactgttgtttatctctcctgagagccaaagatatgccccttgatggcggaaattcaaagactgtgagaggcagtaaaagaaaggctctgggacagggttatttttcaacatacacctcaaaacacacagcgctggcagctcctatgagagcacatgtatttgatatccaaatttttctagcctagtgtcccacaccaatcccacaagcacaaatgtaattcttcaaaaaggagcatgctaagaagtgccctgaagtttgcagaatgaactcatgcagcactttctgagcaggctgggttccccttgcctatgactatgcttaccgaaggtcaggcttccctttgacaagacaggacaggtactgtatgcttagtttctctcctctgtctcaccagtttcggaggcgtgttcaggttctaacgtcaggggtgaggtgaatccaggtgaggaatggtggagtgaaggatgcagtgatgggcctgagctgcaggcagtggtgataccagctcctctccatggctctcaagtcttgaacacacatcaattcctctgtctttcttcatggctgaaacaattgtcaggttaacatattatggtaaatataggtgagaaggtgacacttttaagactatgcctgaggctgttgctcccaggcactctccttattaagcttctatattagtttaatattagtttagtatgctgggtctgccatcacaaagcacacacagtgagtggcttacagcgaaagaaatgcatcatctcccagttttggaggctggaagtctgagatcaaggtatcagcagggttcttccttctgaggactctgagagagaatctgttccattccttgatcgtagcttctggtcgtttgctggtaatctttggcattttgttggcttgtagaaacatcatctgatatctgccttcagggtcacatggcattcttgtatgtccgtttgtgtccaaattccccctttgtataaagataccaggcatattggattagtgctcactctaatgacctcattcagctaatttcatctgcaaggacagtattctcaaataagttcacattctgagatactggtggtaggacatgaacatacaaattttggggaaacagaattcaacccataacaccatagatacttggttcaaaccaactctcctgaatcctgaccttcctgcttgctccataaagtttgacttgattccctcagttttcctcaggatttcagtggcttccaccttttgaaaacaaaagctgattttctgaattataaataccaggcattctgattttagcaaatgtagaggcttttgatacggataaagaaaagataaacgaaatccagaacccaagtcatagatcttgagtcatacactcaagcgcagattcatgtcaaactgtttccttttagtctttcacatatatctatagacttactttaaaaatgaaaattggcattgtttatatataatttctcaccgggcttattttaccagtgttacattgtgattatctcatcaaattattcaatattcttgaaaatatgagttttcttgagctacaaagctatcacaattggtatcctgttactgtattttgctttgtgcctaatttttttgttttattatattatcagtcccttaatatgtcattttcataaccactttttctctaatgactcaaaagcattccttcagtatttgttctaatgattactcttaaattttatatatacttatccaaacttttttataggtgtaaaagccaagaataaaaaagtatctatgggtttcttgggtataaagtgggtaattttatataattttaattttttattctttctagtcagttccttgttccaataacaataatgtgagactttatacatggtgatgatgatgctgacaatgatagaattgattttaggtttcatgaccatatcatatcttttgacataatttatgtttagctgagattaagttatgcaatacattcttgagttcttttgataggctagaagatgtatctgagtaatttttcccagaaattatatgtgagtggtatagctggtgagaccttgaatctgggtgaatctctttctttgccctcatatatgaaagataagatggctgggtatagaagtttgctcagagaggtgcatattctgttccattgaccttggatgatgaaacccagtgttttcatgtataaattacctgttttaccagcctgcacagttagaaaactttctttacccctatatttcaaaattctttgatatatgtttcagaattatttctcttttaaataatatttcggatacttcatgaatttttctatctgaaaacacaggattttatgaactcttgaatacatttaaaaaatattttctgggctgggtgtggtggctcacgcctgtaatcccagcactttgggaggctgaggcaggcggattatgaggtcaggagatggagaccatcctggctaacacagtgaaaccccatctctactaaaactacaaaaaaaaaaaaaaaagctagccgggtatggtggcgggcacctgtagtcccagctactctggaggctgaagcaggagaatggcgtgaacccgggaggcagagtttgcagtgggccgagatcgcaccactgcactccagcctgggtgacaaagcgagactccatctcaaaatagatatatatttttttctttaattatttccttttctgtgtcctgaattcctggaatttttggaaaaaaataggttgaatattcatgtccagttcataggtttttaaattgttctatcaggggttttttttctctaaatttttgtgaaacatttatagtttgtatttgtattttaccccactaattcaattttatgcattattctactgttttcagtccttaattcatttatcatgttttttcatatctatccagtttattcacatcctagcctatcccctcattttagcagattgttctagtttcacatacaaaattcctttttggtttatgttgtgataattaattagatgttttctaaaacactaatttttactgtttgctaaacaatcttacttttgcccttcagtaccggcaatcctgagcaaaagaaggcttgctttgattgccagtaaaacccatgttcttgtggccataatcttcacctcacataacctaaacaccctccttggaatattacaaaattctcccgttcccagctgcagaactatatgaattggatttacagatatcatagtttttttcagcatccacatctttaacttgaatttcaattaaaacttattggttggtcaaaacttaaactcttagaagattttttgctcagataccatgtcaaagtttagaggacgttcactgaatcctttcctctggccagccttactttcctgtcttcccacccagacagttttccagaatctgagcattgaaatctcctgccaaacacaatggataacactgaatctcaatgctttcaatggatggcattgaaatctcctgccgaacacaactgatactctggcttcatgttcatgaaggttctttacacccctctaatcccctatcgtacttcaatggttacttccaaggaagttctccaatctgccttttgttgaggaacttttgcatagaagaaagggcaggtgtatccacgcactaggtctaggtttgaggctgccttaaagttactgagggcaaggggcttcataatttggagcctcaccttccccgtttatacatgaggatcatgatagtggacaggcatttttcttagaaataaatgagataatttgtataaacaactttttttttgtattttgttattgtgatcctttcttcatgtctattatgtcaagtgatgtacttatgtgaaagggattttttaatttttcttgtgattaatattaactaagcacaacgattataatttgctaagttaaactgaattaaattgctttatatatctagaaccagaccggaaatatctgggtggttattatagctaaattccatactatagcaataagataaaatatgagttatttactgtctaatatggacatatacatggctctgtatatctatttttcttcatcaaatatcaaatgcaatattacacattagacacaacaattaacttgtgttcatgtttctgaaattgattctaatgtattttctattgtactcagaaatttaccatcaatttgcaagatctttataatgattatttaaagattaccttatttcttcacctttattgtcttgaaaaatggtttctgctcaaaaagaattaaatctgtaaatgacgagttaatgggtgcagcacaccaacatggcacatgtatacatatgtaacaaacctgcacattgtgcacatgtaccctaaaactttaagtataataataataaaattaaatctgtatgaaatattatatattggcaataaaaaatgaaaataaatgagataaaaatagatgttcacgcaaccttaacaactttacaatgctattaaaggaaaattttaggaaatttcctattcagttgggagttgtcatattggaaatgcaaatatggacgtcagagttacagatatagtcagatgcctcaaccaaatcagaccaatgtcaccttttcagatgacaaaatttgaaggagcattgcacgttccagagtcccttgattttcacctgtaatgatagctagttacatgagatgttcttgaattttgaaattataaagcatttttggggggcatgaaatgttcatgaaagaatgagattttaaattttatttacatttctgtttttatctttctaaaaaaatcctaaattaattctgaaatcatcttgctctataatccaaccactagagagtagtataatacctctcctagacatatcattcatgaaattttattaaagtttttattataggatccttattttcttttagtttaataattctatcaactcaattgaagtttatatcaatccctacaatttttttttgcaaatagctcacttttttccccaaattgctgaaactacaaacctgtcatttttcattttgctcttgctttgtcttgaaatacagtgactattcttgtctccaaactctttgtctgcttattttggcaaaatgacaacatttacacaagagatggcaagaggaatgtccattttctttattagataacttcaacaagcatccattaagcaccaaaaacttaccaggcacagagtgcaaccaagggtatttctacaaataattacgaggcttttccttcctttattgataaaacacgcagacagatgaagacataatctgtgtgtgagcacagtgggtcaagcgatcagtacaaataagggtaacggagttcagaaaggggagaaaccaatgcaggatgggctgtcagaaaaatgccacaaagaaatagaggagtgggcaggagcagagccttgaaggacaggtatgaagcagagcgttaaatcaaatgtgtccaatccagaaaaaggggatcccctcatgtccagccaaggcaggacttttcacatcatgtccaagtgtgcaggtcattttattgaaaaaaatatatttgcacagaaaaactgatgaagtctagattgcaaataacctcttttgcctattttggaagtttgaagtaatcctgtgtgcctgtagttcccaacctttttttctgcctaaaaatagaaaatctgagctataaaacctatgtgtcattaataaaaatggataatgatgacagcgatgcatgacatgatggtgccgtcctgagagttgggggaaggtgtgtatagggattgcggcaggggttgggagagtttagagaggggaagcagtgtataaggatgagaagaccctcgaagagggtcccaccggccccctggggagcctgtgcaaatggtgcctcacagcaattaccttgccagggtgtgagatctcccttagagggatagaggcatttgtgcagttctgcagatcagatttctccagggccagggcaacttccctgtccaggcctaggccagttcttttgtcctttcaggattctagatttctcttccagtattatcacaatgtctcctaagcaactgtgctccttgaaaacatttggtctcactcctcagcatcttgcacagtgaccatccagacctgggtcattcattagtttgtctacctcatattcatttctctttgaaatacatctataactcagtatattagctctgtttgttgtttgaacagtctaacagtggtgccaccaacttttggcacgctctgttaaagagactgtagatgacagtgcccttttatattccgccatgttgcactgctattttgtcctagaaattgagccagttaaattccatctgtcttttctttttttataactatataaaatcatgtatcctacatttaaatataaatacagagctttgttagaaaaaatcaggctcgtttgatgataatctttaatttgatatcaagaaatacattctattgagtacctaacatgtgaaaaacgtccaaatcaaattccaggtctttttttctcaggctttttcttcctttgtttccatggaatcacaccttctttctgtagctttgatcctggaaaatgttgtaggcatatattataaatcctgctatatgtaactttggatatattttattgagggtaagaaaattgtctcttggttacttgtgaatatctatatgctgaataaagctgagatgaataaatagctcttccttcctttgtcccatgtcttgataaattatctttttagcttttagacctgatgacttaccttgtgctttatcagaacactttgttgccttaggcaggttcatgtcggcaggtaatgactcactcgagatattctctgcactttgataataataatctgtgatttttgagacatacctatatagctaactggatcaatgtatttcacactgcaggttgcactcattgttaggatctgaaatacatttaatattgtaaggccaacattaaagaaaaagaaagagaaaaatagggactaagcaatatcaaaatgtacctcatggaaaaagtgtaaattattcattaatattttgcattcccacaagtaatagttgaaaagtttagttgtctcagttcttcacagtacgttttaattttagctattctaggaggtatgcgttggtatctcattgtggttttactttacatttccctgaaaatgatattaaacatttaaaatatgctaattgactgttcatatatctcctttcactaagtatctgttcaaatattttgcacattgtaaatggcaaagaagacttttgttttcttatagtcgagttctaagaactcttatatgtgctagataccggtcccttatcatatatatgttttgtaaatattttctcttaatctgcagttggactttttattttcttaaacgtatttttggaagagcaatggttttcagctgtgatgtaacttgttttataaatattttttcttttatagctcaaattatttttgtcccatataaaacatctttgcttagcctaaggtcacttccgttttcttaaatgttttcttccagaaatattacagtttcagctcttacatttaggtctatgagctacttcaagttaagttctgtatatggtttgaagcaataattgaggtccattttggccatacagatttcttagttttttttcccctatgtatgttcacatattccagcactactttttgaattttttctttctccattgaattacctgtgcacatttgttgaaaaccaattaactctatctgtgtgggtctgttttcagaatctaatcagctccttaggtccctatgtttatctttgtgtgaataatatactgtcttgattaggtaactctataatgagtcttaaaaccaagtagtctaaatcctttcactttgttcttattcaaagttgtttcagtcatcctgtatctttggaatttccttgcagactttataattagtttgtcaatatcctgctgggatgatgattgggattgcattgaatcaagagaaataggagaaattggcaaaaacaaaggggctacaggccccatgtaagtcccaaatccagtagggcagtcaaatcttaaagctccaaaatgatctcctttgactccatgtcttgcatctgggtcatgctgatgcaagaggtgggttcccatggtctgggcagctctgcctctgtggctttgcagggtatagcctccctcctggctccattcatgggctggtgttgagtgtctgcagcttttccagatgcatgatgcaagttgtcagtggatctacctttctggggtctggaggacagtggcccccttcttttggctctactaggtggtgccccagtaggtactctgtgtggggactctgaccccacatttcccttctgcactgccgtagcagaggttctccatgagggccctgcccctgcagcaaacttctgcctgggcatccaggcatttccatacatgttttaaaatctaggtggaggttcccaaatctcaattcttgacttctgtgcactcgcagggtcaacaccatgtggaagctgccaagacttgaggcttgtaccctctgaagccacagcctgagctctatgttggtccctttcagccacagctggagcagctgagatgcagggccccaaggccctaggctgcacacagagaccttgggcttggcccatgaaaccactttttccttcaggtctgtgatgggaggggctacagaggtctctgacatgccctggagacattttccccattgtcttggggattaacatttggctcctagttacttattcaaatttctgcagcaaactggatttttcctcagaatatattttcttttccatcgcatggtgatgttacaaattttcccaaccttaatgctctgttccccttttaaaactgaatgcctttaacagcaccctagtcacatcttgaatgctttgctgcttagaaattccttccaccagataccctaaatcatatctgtcaagttcaaagttccacagatctctagggcaggggcaaaatgccatcagtctctttgttaaaacataacaagagtcacctttgctccagttcccaacaagttcctcatctccatctgagaccacctcagcctgggtttcattgtccatataattatcagcatttttgttaaagccattcaactaggctctagggagttccaaactttcccatattttcctgtcttcttctgagccctccaaactgttcccagcctcttcttgttacccagttgcaaagtcacttccacattttcaggtatcttttcatcagcaccccactggactgtaccaatttacggtattcgtccattttcatgccgctgataaagacatacccaagactgggcaatttacaaaagcaagaggtttaactggacctacagttccacatggctgggggagcctcaaaatcatggcagaggcaaggaagagcaagtcacatcttagatggatggcagcaggcaaagagagaatgaatgccaaatgaaacgggtttccccttatcaaaccatcagatcttgtgagacttattcactaccacaagaacaggaaagcgaaagacccaactccataacccaaacaactcccaccaggtccttcccacaacacatgggaattatgggagctacaagatgagatttgggtggggacacagagccaaaccatattagtgagtattggtagtttgtggttttatgagaaactagtctaaggtgtttaatttgtatgtgtagaattgcccatattattctcttattattctaatatctggaagatcttcagtggcatctcgtatttcattacttatattggtaatgtgtgtcttctctcattttcacttcttcagtctttctgtttatcactttgatatctatttcacatcaatggttttagctattataacttatgttgagtagtgtttatgtgagattttttgtttgccttattttttatatctttttgctttaacctttctatgacttaacttaaagtatgtttcttttacacagcatatgattaggtcttgcattttatacaatctgataatatttgctttttagttgaaatacttgcagtatcaaaattcagtgtgattattgacaatgttgggtttcagtcttgctatttgttttctgcttatcctatctatcctttgttctatctttccccctttcttgccttcttttggattaagtccatatttcattgtattaattgtataaaacattattttgtctccattcgtggcttattctgcccctcttttgttgttattgtttgcttgtttgttttcccctacaattcagtgtgtgtgtgtgtgtgtgtgtgtgtgtgtgtgtgtgtgtgtgtgtgtatataattactgtctatcttcaagtaatattgagtctggtcacatatattgttgaatcttattacagtgtatttccaatactcccctgctagacttgctactatttttgtgtgtattttatttctacatatgatgtaaacttcacaaaatatggttaattatcttttaaatggttaattatcttttaaagatattttaaaactgataataaaaggtgttacatttaaccacatattttctgactctcatgctcctcacttgtttacatcggttgaattttttctgatgttcttttctttctgccagaaaggctcctgtgagcagtttagtgcaggtctgtgggcaatgacttctttctactttggttagttttagcaagactcaactttacttacttttttgaattttttttttttgtactgtatagagaattctatatcaacagtttttctttgaaaactttacaagtgtcaccccattgtctctggtttgcatggcaaaatcttgtctttcttgtcttcatttgttcgtaatttaaccctggcccctttagatatttttttcttcatgactggctttcagcagtttgataatgatgcatctcggtgttgttttcttcatatgtccttggcttaatattaacggtacttattgcatctgtggctttatagtttcatcaactttggaactatttatttcaatactcccttcaaatattttttctgttctatctcttctttcctctgataggagtcctaactctgcctcccctaagtctctaattgcacatattctatactgcttgatattacacttcaagtcattgatgctttgttcatttttatctggttctttttctatccgtatttcattttgtgtagtttctattgttgtttatgagttcacagatgatttcttctgcattgcccaacttcctattaatcccaaccaatgataatttttcatttcagatattaaatttcttatcttctaaagtcttacttgggtttaatttttatattctatttccatttatactatcctttttctgccttcttgaaaatggcacatatttatgatccgtgttttaatttccttgcctgttaattttatcatctgtttcatttctttattttttggactgttaaaatggatttatttttctccatatatataattttgctttatataatatatacatatttctgctttagacatgttttgtaattgtttagtggatgtcagccattttgaattttatgttttgggtgctggattttttagttttctttcaatattgttggacagtttactgggatgcagttgagttacttggcctcaatatgattccatcaagccttgctttaagccttgtttgcacagttcttgtttgcatggttccagtctagaactgattggctcccttactaaggtaatattaatacaattctgtggtttctacttgatttctcaaatattcagacatactttcactgacttgcagggatacaaactattcccacctctgtatgagctccagtgattcttgttcttgccgtagccttggctaatcttcccacatgcattatcagaataactcaataaaagacaggggtgggccctctgtaaaactcaggatctgtccacctctcactaggattcctctagtactttttcctacattctagctctgtggcctcttcagcgttgaaactgtgctctcaactcagagaagagaccatcaggctggttgggtcatctctggaaaagcagagatttcactttgttcgctttccttatttcaggcttccctgcatgttttccaaatttataaatcactatttcatatattttgaccatgactcaagttgcataagataaaagggaaaatagggactttcttaatcaaggctgaatgtggaagtgattatagtgtaatgtaacatttaaaaatacaaattacattctaatggaactttttaatgccatagctctcaatactcagaagctaaaggtattgccagtatttactgtacagtttttatgactatgtatttgggagcagttttgaaaatacacccttaggtatttaaattattctttaggcttaatggttttctttctttgtaagcattaatattgaactataattgttatccaaataaatatttagtgatttctcagagaaaaagataaccacacattacctaaacacctggataggtcagatgataatattctagttccattcataacatactaaaaatggactatttggagattgctacctattagagaataaatgtctcatttatcggaatcacactagcctacgaactctagttatgtcatttaaaattatgactggcatcatggggcacacagtgactgcactgcacatgtgagtgaacacgtcactccagctgtgtgtcagacaggggtactgcatcatccctcctgtaggaatgagtgggctcggggaaggaaaatggagggcacatcaacagacaaaaacaaagcctactgaatatccataaatgatgtaactaaatcttaggatagaagaaacctacaagaaccaatgccaacttacgactgatgaatgtctgttgctgtgtcagaaataaaagatattcaattttcaggttgtcaatgctcctcactaaatgtgttccccaaactgaatgtgatgcccagatgatctcgtagggcaatttccagcaaatgtctcataaccagcatgtcccttcacattgtttgtcaatagcctttcaagcccttaaagctcaacatttccagaatgtatggtttcccattctaatgataatctattttaataagttaccttaaattccagcttttcagtgtcctgtccccccaccctatcacagaccttccaacttagtaaccattctttctttctcatcatccacgtcatcaatgaaaattgtcaatgctaaccctgaattatttaggcttagtgtacttcattctttatttaatatattctttgttttcatgttgggcaccgagatgacccagggcttagataattctgtgcctccttgtagcaacacaaacctattttcaggcaaagatgggtaatatcttctgttgttaaaacacagtgaacacagttctgtagtgctgtgtaaacccaccaggtagccagcgagccttataaagagctaagttcctttgatgggctccttgaaagataaggaaccatcaagatattcctctggatctggttcacacccagaagggttataaccagttattaagagatgcataacaaatcacccagaaagttattactcaagataaacatcattgtacagcttatattaataagtttttgggacaggaagcagagcagggttctggagggcagcttgtccctgcttcacatgctgtcacctggactgggtctgaagaatcaaaagtggcctcccacctgtctagaacctcagctgagacagcccaaatgagtgggcttgcagacctctggagcctcgctactcttccacatgacccttgtctttatatggagtgtctcatcctccagggtctcccctccatgtgacctccctctttatattaggaagtttggattccttcttatgtctgctgggttccacctgagcaaaattagaagcttgaaagacctccaaagggtcaccttgaatctcccaggacattacctgcattgctttctattggtcaaagcaagtcacaaagccatcccagatttaaggggcaggaagagtccctacccttgaatctgggagttaaggcaaagttgtctcacaaatgggttgttgacatggagaggactgatttattggagaccttctctttttaaaatttagttttagtggacacataaaaattgtatatacttatgttgcacaacatgctgttctgaaatatatatacaatgtggaaatgtacacaatttattctaactgagctaaattagataaagctaattaaaatatatattactgcagactcattttttgtggtgtgaacatttaaaacctatgcttataatgattttcaggtatacaatacattgctattaactatagttgctatgttgtacaatatatttcttgaatttattccacctgtttaactgaaagtttatattctttagctcgtatctctccaatccctccacctgtcagccccaggtaaccaccattctactctctgcttttatgagttcaagtttttagattctacctatgaggctgggtgcggtggctcacatatgtaatcccagaattctgggaggtcgaggcaggtggatcactcgaggtcaggagttccagaccagcctggccaacacggtgaaaccctgtctctactaaaatttaacaacaacaagaagaagaacaaaaaacacaaaaattagcatgtatggtggcacacacctatagtctcatctacctgggaggctgaggtgggagaatcacttgaacctgagaggtggaggttgcagtgagccgagattgtgccactgcactccagcctgggtgacatagccagaccctgtctcaaaaacaaacaaacaaacaaaaacgttttacatatgagtgagatcatgtggtatttgtctttccgtgcctggcttgtttcacttagcgtaatgtccttcaggtttatccatgttgtttcaaatggcacgatttcattgcttttttaaggctgagttgtatttcatggtttatacatattttctttattcattaatgctttggtggacacaggttgattctgtatcttggctattgtgaataatgctgcagtgaatatgggagtgtagctgtctcttcaaatattgatatcatttcctttggataaataccaactagtgggactgctggatcatatggtagttctatttttagttttttgaggagcttccataccattttccatagtgactgtcctagcttatgttctccaccaacagttcataggggttcccttttctctacattctcaccaactcttgttttctttcatcttattgaaaatagtcattataacaggtatgaggtgatacgttattgcggttttaaattgcacttccctgatgatcagcaatgttgagcattttatcatataccccttggccatttatatatcatctttctttgttgttgttgagacagagtctcactctgttgcacaggctggagtgcagtggtgcaatctcggctcgctgcaactgctccctcccaggatcaagcgattctcatgccttgccctcttgagtaactgggattacaggtgcacgccaccacacccagctaaattttgtatttttagtagagacggggtttcgctgtgttagccaggctggtcttgaactcctgacctcaagtgatccacctgccttggcctttcaaaatgctgggattacaggcatgagccactgtgcccggctatatatcatcttttataaaacaagtattcaagtccagtccccattttttaattagattatttgctttcttgttattgtattgagtctcttatgtattttggatattatcagatatatgatttgcaaatatttcctttcattttgtaggttgtctcttcatgctgttggttatttcctttgctgtgcagaagctttttagtttgatatcatccatttcactatgttccctttattgcctgtgcttttcgggtcaaatacacaaaaattatttgcccagaccaatgccatgtggcttttctactggggaccacttttagcatatatcactaatgcttacccccaaaattgcaccagtggatataatgctaggtcttgataaattgctcaactcctaagtgcatgcatagatattatatacacaaggtctcagagggataatatggtaagatggctgctctgatcccagtttaatgcatgaaagaccctgttacattttcccagggtctacctctgctcagtgctttcagaacataagcatcactcagtatgaaaattattatttttactagacaatatacgccactagattctcagttcctgggggccatgggctatgtcccattcacctttgcatctcccatacttcatggcttctgttatacgggagccagctgcccagttgaaaaaccaaaatagctcaacttgaataatacatattttgtactgaagcaaattaaaagccttgctgtaaccacactaaattatttcatatgtctctgagatcctagaatctattgcctaggtctgttactgggtgtgcctgctgacctcatgaatatcagtcattttaggaaagatgatccatccattgaatcaaaatggaaatgaatttgaagcaaacagtgccaggagtgcaaactgaggagactttcctagaggatgacagcacagtgagctccagtcaaggagggaccacgccttcctccactcactattctatatccaacccctggcctggagcctggtgtatgacaagccctatgtgttaaatggagtgttggcaatgatagaactttccggagaggatatctaaaagtggaattattccctgtgtttatttaagtgcaattcaaagagcaggtttttcagagacacacaggaggagcctggaaaatctgtgacgtgttaagggacttgtgctgtattaaagaaacaccaggtttccaaggaaacccttttagccttgtgcttaatgtttgctcttctgccctcaagaggcccagtgaacacacaattgtttataactagtcaagagactggatcttaggaaatcacttgcaaaattgtccaaaattcctctaaaatctttgatctaagagatctccaaccgcctcttggttcacagaatctgaaacagtatcttaactgtttcactttgctatttatgtacatttccagaacattttgcaaatgtaaagtgcctcgtagcagcattttgtttgtaccatagatgaatccctttgaagttaacctttattgaggcaattgttaaatgcagtatcatgaacttgtgttcacagaagacaggaaaagtgtaagctataggtctgaaataagagagaaataagagagtcagcaagggacacagcagtccatctcagggctttctcatttatgttaaaaagggaattaacatagataatctatgtcagtttcttggcacaatgctgaacaggtagttcagtaagttgtagccatgatggtgatcatgatgatgatgaatgatttggaaacagacatgcctgattttcatattattttctaagatattttcttcatcaaatgttctgaacacttaaaacttaactgctgtatgcttgtcacaggcacattcaatactcaagctttattaatgagcataatgtcctcatcagccattcaagtctagggccttctatcacattttaggctcaactatcttcttttgtgattttgtcattggtagcctcatggtgaaatttatggctctacagagagaagggcatgtgtattgtgtgtgtgtgtgtgtgtgtgtgtgtgtgtgtgcacatgcatgcttgcatacatgtatgtaagcatgtgtgttgatgacaatgattagcctgccaaaccacccatgtaagaaatcggctgtataaggcatagtttgttaaaccacaagtctgattttaaggtttccaaagaaaattccactgggcattgtctttaatttattctttgtaaaatagatttactctgtagtcccagctacatgggatactgaggtgggaggatcacttgagcccaggaggcagaggttgcaatgagctgagattgcatcactgcactccagcctgggtgacagagtgagaccttgtctcaaaaaaaaaaaaaaagatttactaatcacctggacattaaaaaattgttcttttaaaatgtacattctccattaaagtatgctagttcattgataccttttcctttttaatatttcaagggatcactggaaatatatagtgatgcttttaataattatgtcctttctaatcattccacatcattgagcgtgttaagcacacatgatgtcagctttggtgcttgatagaaatgatacaaggttggcatgttattggaagtgcctgctttcagtgtctagtgaaggatattgggaaatagttaaatgagccagaatagggaattactatgaattatggggtgggggggtataatcttgcttccaaattttctcaattgtgttaattcattttttcctgtacttgtctctcttaagtaatacaaagaaataatttattgatagctattgccttactctgagttttgatatgtcattaaaattaagccttaaaactttgtattttgaaaggtcaaaaaatggttagtataatgagaacctgacttcctaaacctaaaattaaaatgtatctcagaatcaattgaatttttccttcaagaaattgttgttaaatcttcctctcaataaattaaaaaaaaaaaaacaaataaaaaagacaatgtcaattttgagttaagtgccattttttttaatcctgtttatctacaaggagccacagtctgcctaactttaggtaaagaaaagcagtatcacttggaaatatatagatagtttactccccgtggaaaaaatcattatttctccatttagaaataatttcacatttaagatctctagaactttactttttccctaggcagatacttgttctaatgatctgagaggtaaaaactcttagcttagcttcttcttaggaatctaataccatttgtcttaaaaataatatattttagccgggcgtggtggctcgagcctgtaatcccaccactttgggaggctgagacgggcagatcacgaggtcaggagactgagaccatcctggctaacacagtgaaaccccgtctctactaaaaatacaaaaaaaaattagccgggcgtggtggcgggcgcctgtagtctgtagtcccagctactcgggaggctgaggcaggagaatgacgtgaacccaggaggcggagcttgcagtgagccgaggtggcaccactgtactccagcccgggcgacagagcgagactctgtctcaaaaaaaaaaaaaaaaaaaaaaaaaaaaggaataagaataataagaataaattttacttgaccatttagaaatcataaatgttccctgtcaaccacacggggaacttaaaagggggaaacatttgattattgtccagtgttgctctgctcagttgggtgtaaaatatagctagcaaggctgggccgacttctggagaaagaggaaggagagctggcaagacgggcccatggcaggtctccaggtcagcagcctccagaggggaacatggggcccctttggaaggccctggcttgggctgggctttgtgctgttctcttgaccctggtgggaacatggctgtaagaataccatccctgtctactctccttatatcctttgtaacatatgattatcccatctgcagcacattttaaatcacaatgccaaagtgcaacagtcctcaaggagtggtccctgcacgcttgatggtctccaagaccctttagggatttgcaaggtcaaaactactttcaagataatattgagatatcattcactttctttgttgttttgacatctgcaatggtggataaaattgctggtgtctcagcaggtgtcaaggctgcgggatccaattatacttgttttgtgtaaatagtgtactatattcttcactgctacacactaacagaaaaaaaaatccaattttattgagaatatcctttatgcagccatataattattagttttattttatctcaacccttgagtatatgactttttaatagcctctgtgaggaaacaggaaatgtattcccataaagtgtggttattttgaggaaaagcatttgagtggttgagctgcaagctgaaataatccttttcttaatagaactttaaaaaagttacttttcctgttactgttacttttacttagcggaacaagggacagaaaactatggtaatttggactacagatgacagttattttctcaaagtatgaaccaaggtgatcctgttacttcaaggaaaataaccaacagtatttgattcaatggtaaaatttttcaaacaaaaattcaaattgtggaaaaactgtatccaccattatgtacttgacagcctcccaatatttaaagaacttttgtgatgagatcagtgattatattaacaaatatgattttttagtgttatatattgaaacctgtcaacatttgaaagatctgcataactcagtgaactataaatgactaatgcatgatgttacaaaagtcatgcattagtaatagatccatttaaagctcaagatagggcaatcaattttaacataacagagtatgaaaataccattccaactaacctttaagaaattaccccagaaggccaggcacagcggctcatgcctgtaatcccaaagctttgggaggccaaggcagaaggattgcttgaggctaggagttcaaaaccagcctaagcaacatagcaagaccttgtctctacaacaaaagtttttaaattagctgggtgctcatgccactgccttccagcctaggcaagaaacccagaccctgtctaaaaagaaagaaagaaaaaaaacttacctcagtagaatattcacaattacttacaaagactattaaaacactcctttattttccatctacatatctctgtaaagcctgaatgcagatgcagatatgagaattgagcattctattagggtagacgttaaaaagatttatgaaaatataaacaatattactcttctagctatttttttgttttggaaaatacaatgttttcattaaaatatttttaaataatgtaatggggttactatttcatttttaaaataaatacatattttaaaatcttttaagatttctaccacactaaatataaatagctacaaatcacataatgaaacctctttatggtctccaataatttggaaaagtgtaaaggggccctgagacctgctgcacgggaggaaggtgctcccggaacagggagaaaggttgagtctggggaatgctgaccatgacacctgcttcaaacacagattccctgtggctgtttttcctctaggattctgttaaaaatcctgttgaagaatccattccacatatgggtaaaatttagaaatatgttccctggaactgggaaatccagggacaggagaaaaaagcagcaacattgctttgttactttgttttacttgctacatcagacaaaaaacaaaaaggaatggatataattattttacgtacctcttaagggcagtgtgaggtttatgtgagtcaacgtttataatgcacttaaggcatacttgtcactactaagtttatataaattcttgttaaataaaaatgaatgaatgaatgaataagcagcttctaacagaaaccgtggcagcattttttgctgagcacattgctaggcagtaactaaattaatatgatgcttgacctcagagatttaggaagttggtccaatctaggcacatgcagagaagatacgtttagaattctgaattttgatggatattatctcaaatatctttctgaaacacagcgaaatataaagacttttataaaatcagatagcatgcacacaggaattgacaatccaggctctccagtttaagtaggtggatttcctaaagaactctaaagatatttaggaactagaagtgactcagcttccaatatagaaacccttttccacccatactctcaaaatcaatgtgaaatagctatttgtagatggaatctttggactcctatgttttgttttgttttgttttgttttgttttgttttgttttgtgagacagggtcttcctctgtcacccaggctgaagtgcagtggcacagtcatagctctctgcagccttgacctcccagtttcaagcagtcttcctgcctcagcctcccaagtagctgagaccacaggcatgtgccatcacacccagctaagttttctatttttgtagagtcaaggtctggctatgttgctcaggctggtctcaaacttgtaggctcaagctacttgcctgccttagcctactaaaatgctgggattacatgtgtaagtgactgcacctggtctggaccccaatttggctgaatcattcattcctcaagcaacaagtacttacatgggagatacaaagaaaacaatattgcctcttcttagaaagaaactcctaggctgggtgcggtggctgacacctgtaatcccagcattttgggaggcagaggtgggcagatcccgtccctactaaaaatacaaaaattagctgggtgtggtggcacacacctgtagtcccagctacttgggaggttgaggcagtagaatcgcttgaacccaggaggtggaggttgcagtgaactgagatcatgccactgcactccagcctggcggcagagtgagactccatctcaaaaaaaaaaaaaaaagaaagaaaaaagaaaggaaagaaacttctaatttcacagtggagatttcagtgtgtatgcataattccaaagttagcggagcagacagagcaagggtgttgggactgtagagccctagaggctaattttaagtccagctccaatcattttgtatctgtgtgacagcaagcaagttatttattattttaaacatgggatagggaattgggggtattttgacattttaggaagaggaaatgaatggtgtgagtgagcacaggggagaaaactgcaaggtctgttgggaaccatttggagtcaactgcaaaagggatccgggctgtaggttaggatctgggacaaggtcatgtttaaggggaccttgaacttcaggatgctcagaataactgaggaaccattaacattgggtcacttcttaaaatgtctgaatcaaagtgacatgtcccctaagagtgtataagtgcccagagcatgaagattccgtagtttgtagacaggcccaggaccagggaatttaggtaagttttttcagcaatagccagcagaatccaaacatccttaatgaggtactgtgtgcagcacagcctcctaaactacaagcttactctcaaaagtgtaagttgacaaggagtaatgctccgggtgctcttagagtagtggtagaactagtggcagtagtggtggtggtggtaattgttgcagtagtaatggtggtggtaataatggtatagcaataatagtaaaagtagtggcagtagaagtactggtagtggtagtagtggtggtggtagtattagtggtagtagtgatgatagtaggggtggtagcagtattggtaatagtagtagcatagtagtggtggtagtattagtgatagtagcagtagtggtaatagtggtagtagtagtaccgccaatagtaatagtggtagcagcagtggtaacagtagtattggtagtgttgccaaaacactaggggttcagtctaggtcctactgctcgccacatgaatgccaatcactgagtgttttaggctgttcttgaattgctataaagaaatacctgagactgggtaatttagaaagaaaagaggtttaattggctcacagttctgtaggctgtacgggaagcatggcattgggcatctgctcagcttctgggaggcctcaggaagcttctcatcatggtggaaggcaaagggggaacaggcatgtcacacggtgaaagcaggagcaagggagagagtgagagggagttgccacacacttttaaatgacaagatctcgtgtgaactcagagcaagagcacactcgtcaccaaggagatggccgaagcccttcatgagggagtgaccctcatgatccaatcacctcccaccaggccccacctccaacacgggatcacatctcaacatgagatttggcagggacacagattcaaactatatcactgagacaatgattattgccagtgaagaagactattctggtgctgcagccaaggagatagaagatcagtctcaaatccatctctcagattgattaaaattggggtttttataggatgaaagcaatgtaaccatgtgtgggaaaacaggaattagggaagggtaaggaaaaggagtttgtcaataggaagcaggtggtcagttaggcaatcatgataggtgagggtctggtacctcactgtctagatgtggtgatctgggaagtttcagttctttgatgttatctgggaggccctcatggttagtttcctaagaaaaggacttagataagacaaatgtaattttgtcaagttgtaagactgggagggtcaatttctatgtttattcaaaagaaactataaacattaattctataggacagttgggccagcatcagttgtagtagctgtggtagatggtggtagtggtagtagttgtggtaggagtggtggtagtagtagtagtagtagtagcagcagtggcagtagtaggggtaataacggtagtagtagtggtagcagtgttttaggggcctgcattctccagtattttcctcacagaccagtggccacaaccatttccagttaagtgttccgttcctggtgggcacccagctcaggaacactgcacgtgtgtactgtgagttgccccccatctgaaatattcttcacctgctcaccctccattactgagctgaaacttccacaacaaaccaacagcctccttgtgttgggaaaccgttcccattacagtagatattaacgagccctaaatccaatctaactgaatttggctaattcctaaagttaggattttctcagaagttggcgtgatggtgaagaatcccttttctctggtacccgttatggttgacaatcagtgaagttttcttgtgcaattgcatggcatttaaacattattttagcatatttttgtgaactaaatatactattttggaatttgaatttatcttttggtgagacatagtagcaaggaagaggaagtaaacaaaatctctctagtgaattaaaatataaaatggtaaatgtcatctcgatttaggaaccctgtcggcggttcagaagcaaaatgagctgccctgagttggagcctccatgggacccgcttccgtaggcacaggcataaagtcagctttctgttgctgaaggcttggaagaggctgcaggagaacactgtaatcagatttgacattccgaactgatggctgatgggctgtgagggccgtggcagggagtgatttcaggggctttaataaggcttggcaaataaatgatcaggtcacactgtcactgtgtgaatgccaatgtctttctccccaatccattccctgagaggactccagggccaaatagaaaataaatttaaaatgaactgtgaacactaaaaaatctttaatagactttgtccatggaaagtgattcttttttataaaattgctttaatgcccattttctttgtgttcatgaatataaagagaaaacaaaaccaatagcaaggtctcagtatttctgatttttttttaagttttgtgatttaagaaaaaaaaagaaatcaaagatacattccttgcgaaggcaactatggaatctacacccaaatctccaaattatattcataagtcaattgtaactaattttagtattcctaaaagaatgaatttacaaattgctctcaacccttttagcctaaaatataggaaaatgttacagtctccaggtaggaaaaaaaacatgcgtcattttacagctggataccaaagagactcaaatttttgatctaaaagaaaaaaaaaaatacagaaggaaagtaaaaatagacctgacctttgaaggcagaaatttcttgtctttaaatttgactttcattttctttcattaaaataaaaataaaataaaataaagaatgccccctaatagtctcttctcaagttaaaaatactgcaccacatcaaattatttttggaaccagccaagagaggaaagggaggaagaagttaaaatacaatgctatcatttcttattgaagttagaattttcataacaatcttgccaatgtttttcgtcaattacactgactgaacacagtatatttgtatcaaacgacattgtttgaccactcaaattaaccatgtaaaaattacctaattctacctttacttccttataaattttccttagagttcccttgggaaatatttaacatacagtaaagatcctgggattaaagttttaaacccctctgccatctaagactgtctgtatttctatcctaatctctcttagtactccccaattacacacaaaggatccaagtctgaactggtatgccttcggttctacagttctcagtgttgaaaatctccctctcccctgtcttccaggtgatattcatccattatccaaaacctcagcccaagatcaaggctccctctagggaaaagatagcttggccctgctaggaagaattttctcactcttctgtaaatacttctgtgcagggtttgtgtggctcaatattgcatttccacttctttctggtttacctgccttggttgaagactcagggaagcaaaaagctgcattcccagacatagctgccagggctctggaagcggttaaaacgcagtcagatgcattgtgtatgtatggagacttgagagactctgacagcctgttgagtgcaggttcatattctattatttttcatcctgactgtataaaagccatctggtctgatgtggaagaaagaatgtggcattgggagtcaggcaagcctagattgtatgaccttggtcctcaacctatgcaatcttgctgaaactcagacctctcattcaactaataaaaagggttaggggaattaaatgaagtaatatgaaaaatgcctggactgtagtaagcaataaagatcattgttcttatctttatctcgcctcatcttcatattctaggtgaagtagataagtgtgaattcactgctgtatttagacccccacaagattgtcattgcattaaaccacccaacaactgccttgactattccatgaatttatcagtttgatgtctttctttaagaaaaagtatagatttgaccacagaaactttccttgagagaactgtattaaagaaataattagaaatgcagaaaaatatctatttggaaacttattttaattataatggtgaaatattagaaacactcaagaacagataggctaatccaattattatatacccatccaatggattattacacagtattaaaatgatgtattaaagcattcaaatgacaggtagccactcataatttagcaacattcatacaatattcattgagcacatgaatctcataaaaggatcaaataaaataagctgaatggaaagctatttaaataacagtttaatctcaattatctaaatactatatatatgtagaaaaaagcatagacggatatatgcaaacatgttaataatggtcagctctggtgttcagctgttcatccttggtaatggaattatgtgggatttatattttattctttctagtttttatttttcagatttttcacactgtgcctatacttgtagtcagaaaaaaatgtaagttaaagttttataaaatgataatatggatttcctattaccttgattttaaaaaaatatgcctataaaaacatatacatttagtaaagtggctttctagaattttcgttgtattttctcctccaaagcacaagctcacaaaagggctgggaacatgtcttttcatgtttaaatcttaatgaagactcatccatgtattccctgttcgtggagctgttatggattgagtgctgctccgcatcagaggtcatgcacgtggatctggagattcctggatgatgaaggggaaggtgccagagcctttgggtatggctttgaagtgggagagactgagaaatcattacctttctttggcagtatacctttaagtctgcactctttagatttgagggcattctaaatctttcatccaagaagactttgtggtctcaatttggagccgatattagggaaccagcctttggagctgcgtgcattaaatatgggcttacacttgatgtcaaggaagcaaaatttgcctgatatctaacatgcactaataattctgtacatgtgtatcagctcattgatctttttagtacttgatttgggggttgaattgtaaattttattatatcttttgaatgtgttaaaatttttttcatgattaacagttgaccttgtggcttcctaaggagctctggccaagctgtgtcatgctttgaaaaatttcactgagttgtggacattgcttctgaggttatattcactgtactactgctctttggtcctttatgggaagcatctcttcaatagcatcttgcagagcttggcaggacctgggggaaatgctcgtgtttgggagtagacccagaggcttcaccgttctgtacgtggtggcttctttcccttctgcgtctgagatacataacacattccccatcctggaattccaattccagtgttacaagaacttgtgttctacccttctttctgacctcgaaggatacttacaataaattcatgtgattattactttctacgtcgtgttggttagtttcttaggaaatcgttgaaaatatatgctttacaggagtaccattttctaatccactctcatcctataactatttaaaaaatacatatcattttaggaagagtgtggcctatagatgaacctctgatctgactatttgaggcttgttttattgctcttagatttttccaaatatttatcaaacactgtttatctttaacccacactagaataatacatgattattattcttaatacctgtacataaatatcacttataggcattaatttttatagtactaataggtttgcatgttcaggaagtactgaggattaaaataaaggaattcctctcatttacccaatatttgaatatgagatttaagatgtgtgttggatgccagacgaggatatgtagaataaccatggagataatgaaggaaataagaaatgacttttgaaaagactggtcaaggcaactaccttatgaagactcagcctcaggtgggtatttcaccggcgtggttcccacagcccgaactccatgctctttttcacatctgcttcccccttggagaggtgctttctctctgggaagaaagaaggggctagccaaacttcctggcgtgtgagatgacccagagtcacattctaatgcctagtctgtgcaaattgtgtcaacataccatactcaaaatgagatttttgtagttagcaatcttctaatttttgcaacgagaaatttccgataacagcaatgtggtaatacacttctctaaatatttgcagtgagcaagtatgtattgagtgaacatacctgatgctatgtgggacactgtaggagaaatcatcatgcaccagtggggagacatcctgtcactgacactgctcaagcttacgctaacctgtagaaaaactccacagtatgaacaaccctggagagaaggataaatcatagtatgaaactgataaaattttaaaaagtccccttccaaagaaagaaacattgaaatgctctatggttgtattaaattactttcaagcacattgtatcatttgatcaaactaagttgatggttctctaatcttctcaatctgcattctttgcacgtaatttacattaactatagcactcttatttcaaacagcaggtgggtagactgtgtaaaatttagcctccctccagatttctatatgtttgtgtttatgcactcagcgatttttaagcgtaaaattggcttcttatttaaagccaaagtgagtgaatagaatactcattgctgctcattctaacagccatgagtccagcccctggtaaggcaatagctctcacctgtctttgtgaatattatttatattgcagcatttgctggtatggttggaccttcagggattgtttaaggagcacaatgatttcatgcggtctgcatcatccaatatgaaatgttatataccttgaaatatttttccatagtgagaaggtctccctccactccctacacttgcaaagaaccatagatacagttttctttcttttattttaagcttgttgctacctgaggtaggcaaggaatgagctgctttgagatgttataatagattcaattgtgtcccctcaaatgatattgaagctctaatgcgccagtggctcagaatgtgaccttatttggaaatagggtcattgaagatataagtagttaagatgaagttgtattggagtaggatgggcccttaatccaacatgactggtgtttttgtaagaagagggaaaacttaaacacagagagaacatggccatgtgaagatagaggtggagattggaattacgctgccataatccagggtcattgaggcctaccagaagctgggagagagaagggaagatcttcccttgaggcattggagtaggtacggacctgccaataatactgctggcctccagaaatggaaaagaataccctgctatcatttaaaccacccggtttgcagtactttgttgcagcagccctgggaaaataatgtggatgccacatcagaaggtgaagccaagagcacagcacggaatagggtgcatcagcaatcagctaacccaaggctatccaccttctctccatgaattattcaggtcttatttttgtacctgtcagtttttaaagggagattgtcatctcttgattggctattacggatccatctaaaatggttgctgtctaacagctgactgatagactccacactttttacccctgtgcagtgaagaagagtcaaaagaacaaaaatgtagtttttgattgaatactaagatcagactcatccacctgctgagcaggtctgaataccactgcacatgcaactgggcaagcatagtcaaaggaggcttgattaagcaaaacgaagctgagacagctccagcctctcccttgccccaccctgtccatgcgtgcagctccccctccaggagatttgaaagggacagggtggggtggtgggggaatggatagacacaggatgagcaggtgaccaaggaggcttattctcaatgatgcctgatgagaagaaacacccagacttgtagctctgaccacacaatacgtcctcttaggatacattctttctcatttattccccgtgtcctcacgtccacacctgttctctcacttttgcatccttcccaaatctgtgttcttaagttttctcttccttgatgcatgaacacgtggcatggccattgggtaggaagcaatgcaggcaaacaagtcggccagtgtacatgaagatttctcgagagtacttgtccattctgcgatggtaacaggctatatcttctttcaaagacaagagtttagggtgtggtttatcactcttttcattaacctgagtcagataaatccagattctgatgtactttatgttttagatggtaagctctttgtcaacttggttcatatggttaaaatgatttggagaatttaacaaataatttaatcaatatacctggacagtattaatgataaaaatcctattatggtaattcagcatagattttctataatctattgtggtactggccaaatacagtggatatctttggaatgtgccagaaagaagtggtgcccactaatcagatgtcttttttagaacattagctgttttttaacggtcctcttttttgttatttctcttcataaaatattggctatttaaaagaatattctctaattaaaatttaatgtcaggaaatgaaagaaagatggtttcaatgctagacatttataatgacttttgatttccttgctcaaatgacaagtgaagttttctcagcatgacatgagaataatttatcagaagatataaaaatgagcaaaatgtacattggagaaaacccttttgtactctcaagaagagagcaaattatcttaaaacacgggggatttctattcatcttttatgcaggaatatcctacttttattaaatacatgttgaattacattgagggaaagagtaaacttaccatattgtatcccacccatttctaaatggcacagggtagttacactgtacactacatttactgtaagaattgctaagaaaagccaacatgaaatgagcatgttctacctggaatttataaacaattactaagtgggaaaatgtggggagaaaatacagggaatgaaattaaaaagcaagatttgcttacccagagtggtgaatttataccaccctactccaatagggtatgtgcatttgaatggattgtaataggttttagtaggattgaacacactttccagaatgtgaagtttgcagtgcttagagttgtatcaaatattttcaaagaacacagctggtttatcagtggaggagggggggtttaaaatggccttaactcccgtgattttcctatgaagattaaatagagtaatgaccatgacagccttatggaaactgtaaagagcaaggtctggtttctcaaacagtaaagagatgcctgccaggttaagatgtgggtgaaatggaatttgtggaaaagtgtcaaaagcactaaagagattgcttttcttcacccacaaatacagcacgctgacctacctcataccgagaaacacaggacttcatgataccatctgctgtgatctccctcccatctgaaatgcaattgtcttccagtgttctagaggcatctaactttttatatcaatcatatttgccattattatcactttatacagtcattatttgtttagggttactcacgcatacctcgttctttctccacccttctttttgcatctcattattgagtacaatttcttttctggaagcacatcctttagttccaggcgcaagcctgctattggcaaactgtcggttcttatcaatactgggaaatttccaaattgttttcccaaatattgcttttctgccatttttttctaccctctccttgaactgtggatttcctctatctctccttcaagtctcttaacctttctttcatatgtatctttctttcttccatatgtttctttttctctctaggaaatattctgagtaatttctgtagatttattttcttgttcactaatttttcccaactgtgtctaatataaatatttatgtcaagggttatgtgttttatttctgcccattctgcaaatattttattgtttatctaatatttgtatcttttatgatatactcttattcacttatcctatttttaattcaattctatagttttgcaacatttaaaatacttattgtgtaaacattgtcgagttatttcattgtctgaggcctctattgcttcttctgactcctttttatgataaattgttctctaatgtgttagaggtttggtactggaagctcaagattggaagggaggagtcaagcttcatctgtaaacatttctcagtgctccttcctccagggaagatttatttgtctttgcttctgccagatgtccttagaagcgaagtcactatatgttattttctagagtgaggtctactggaccctggagacagtgagactacaaatcccaaaccagagcaaggccagtactatggttagacataatccctacacaaagcttaggctaggaaggcaagggtatttgcaaaggctgtttttttttttttggaggtccaatcttttagtgaagttgtacttttctgcagacttctcttgtgtaggacttgtgtaggactaacagccttccatttcctcattgctgttaaaactatgttttttccccctaaatgtgcaaatgtcacagggaaattataggtagtatcaacaagatctttgctgttaggtattcaccccccctcttcctttatagagcccagagggctttccttacctgagaaacctgctgttcatttaagtcaatgttagatttatgcagcttgtctaagtttcttatacctggagagttttcaaaataattagttttttacatagtcagaaatggaagttgctacaactcactgctgattcactgactatattaaactacctgaaaaaaaaatggaaaaataaggttccaaataatgtaatctgacatacatttcatgagagaaatgaccaaaacttaatcctagagggaattttatcttaaaatcctagagggaattttatctaaagaaaattcattagatggttgtaaagcaaaaatgaaattaaaaaataatataaataaacgtggagttcaagaaaaacgtcactgtttccacttttaagtggagaagtaatttgacaaattttcattgaaagaattttgctgatcacgagtttctatcaaaacccaagaagtgtaaacataggaagtgcttataggttaataaagcaaaaatcatgtgttattaacgaggaagtgttaaggtggtgccagatccacgggcactcactatttcatttctgggagcgtttttcagcctgcagttcccacaccacgcgtgccgtggagctctctgtgccacgctgcggggcctcggtctgaccagcagggggcaccgagtgttctcccgcagcggcccggcgtgggcggcggctccaaggccgattcctcagcaccaggcaggtgcctttgaagcaaagggcgttcattcacattcacaaaggtctccggaacagccttgtaggttcttcaactgccctcaactaaagcttcggaatctgaaaacctgggaagaagcttagtgtcctgacagtattttccttttaattttgcaaagtttacaaaatccattaagaattgctttgcaatgaaaaatatacacatttttatactttttgttttcaagtgcttcattccatttatatttagcggtgaggcgggcctaggcaaaaatgaaataaaagcacagtgttaagatctgcaaggccattaaattgcagtgcacgtaattaatggaccatgatattgcttaaacacaaatgtacactaatcttgatccagcggtactagtgatttgttgttacagggctagatccacctaaagctcatggtgaacacttacaaccttgcacagaaagtgactgtgcttgaaagcacgaaggcaaaatcccattggccaaagataccttgtattcctagctgtgaatcggtttatcctctttattttatactttgcattattttattacttggaagaattcacccacttttttctgacaaaggcttatcagatttttcttcttaaaaaaatatatataaagttttgaagaaaagacaaagcattgcaaagagctgtcagagggggacgagaagcttacaaagtgagcaggtggcacacagcctgtctgcagtggtcatgtgagagccaaacccctcagccacattaacagcctacagcatgtgccaagcccttaagaagtcacatagcatttcagagaatcccacaaaaccaaaaacacaaattctgtcaatgcaatacatatatttctaggtagacgtattagtacgtctcttatgtgggtgccgaggaatcttgtaaaagtttgtgcaaaattgacgtcagttttactgcttgtcagcagtgaaatgagtggattcattgattcattcatttgacaaacatttaatgaaccactactctgtatgtgttctagggactgggaatacagcattgaacaaaatacagaactaaatgcatgcttgatggagcttttattgccatggttagcatgagttacattcataaaatatactttattttcattaaaaagaatgagctagatttctttatatcaacatagagagatcttaaggaaacataacgttggatgggaaaagtgagtttttccatgagaaatagtaaaatacttatgtaagtttgaaaaacaaagagaaaatacagaaccatactatgtgaagttcattgtcacagctatgtgtgggagtgtgtgtgtaataaaataaaaagtcgaaactgggaatacacactaatatttctgataatagggttttttaggagaaaaatataggatggggagggaacaaagagaaaaataaagcattttctgtaaagttttatttatttcattaaaaataaataaagcaaattacaccaaatgttaacaatgatcaattttaagaaatgggtacatggatgagtatgtcatgcctatgtgggtgattggtactttttcagttaaataaataaatggcagttggaggagggacagagaaggacatggggagtgagaccaaacaaggatcatgatgagaccagaacttccctagaggagtggcccgttgtgagcctgagagatcccctgtagcgacactgagcagagctccctgtgcctctttccgtcctggcctcacgctgtctggttggctttcccgatccgtcgtccatctctgttgtcctgttgttgttgttgtggttttgagatggggtttcgctcttgttgcccaggctggagagcaatggtgcgatctcagctcaccgcaacctccacctcccaaattcaagcaattctcctgcctcagcctcccgagtagctgggattacaggcatgggccaccatgcctggctaactttgtatttttagtagagatggggtttcaccatgttggtcaggctagtctctaactcctgacctctgatgatccacccacctaggcctcccaaagtgctgggattacagctgtgagccaccacgccaggccttctgctgtccagttttagtaacagctttagcaactgccttgctctgctctcagcattctctgttttaaccatcccgatttcacctctgcctcccttatgtctaccttttgtctcacagtctgacaatgaaaatcatctgccactatcctagcaccaacctgtgggcctccctgaactcccacttacctgggccacgtcagccctgcagcccacggagctcctccagggggtgcctctcctgtgtttccttggctgtgatctccaagcagagggcaggccaactgcgtgtttcctagtccccctaagtagcttcatctttccctcctagcagtagacccctatccctttctctaagaaacactgtataacccacctcttccaggaagcatcgtgaacacagtacttctcaaatctttgtcattcatgaactatctttatgatatctgcaatcattgaatgccatctgtgctagtgtttttgtcctttgaataattcttgtttacttaaaacaatgtaattataaaaaaatgcattactacttttaaatggaaaatcagtttaactagccatacagataaatgcaatacaatgaaagaaaaacaataatattaaattctagtcagatacaattgccttccaaagactctaaaccagcggtttacttttcctttgtctaaaaaaaaagaaaagaaagaaaaaggagactaagaagtgttagagcaatagtgaagataacttacttctgcaaaaacgtgctgagaattctagtggaggcacctaagtcagtgagtggataactggtaccttctgtggctttccctttgaaagaatcacaagaattgagatttacagaggagaaaaagtctcaccatgtgtccggatatcatttctctatagcgtcttatcagctgcataccatcagtgggttccactccattttaattcatcatggatatatcattttcttttcttttcttttctttttttctttttttagagggagtcttgctgtgtcacccaggctggagtgcagtagtggcatgatctcagctcactgcagcctctgcctcccgggttccagcatttctcctgcctcagcctcctgggtagctgggattccaggcgcacaccaccacgcccggctaatttttgtatttttagtagagacgggttttgccacgttggccaggctggtgtcgaattcctggccttaggtgatctgcctgcctcagcctcccaaagtgctgggattacaggcatgagtgacctgcccagccagatatatcatttccaatctctctttacatcagcgcttacgtatatccaactgacactgtttgcctctgttttgcaattgtttgcacttttactttatggtatgtttcctttccttctcattaggaattagccttttaggtaacttggattccattactaggtctgcatatgatgggcagttgctacatgattttattaataccattttgttacaaaggttattgcaaggcaatggagtttgtgataagctagatctggggaagtcatttagggaattgagttactctcacagtgcaaggctctgtgacatgaaagacagtctcaaagattctcatggggtcagactatttgaaaccaaaaggcagtggagtgggagtgacacgagggaccgcatctgacatggtttctacccttgcgtgttcttgtaagtatacatatttgcatgtacatttgtatggatagctcagtaaactcattatagtttcctttgacatcatcacgtgtcattgggaaacaaatgtaatccaagaccttcaaatgatgttgcagttttaaaaaaataaactgctttctctgctattcccattataaatgcaaccaagcctatggccttatagacttgctggtctcaaagcatgtgtttgaggtgggaaaaaatgtgtcatgtccaaggaaatgatacaagatatactttgaaaatagaactgataggacatagaattggcctgaatgtcaggatgaggcaaaggagatgaggaccaaggcggctgctaggtcttggtgaggagccctgaacaggtgaagagtccccctaccaggaataagaactaggggacttgctaaagcaggaatctttaatttaaaatgcagaaatatttaaagagagaactttaagaatccaaggtataccagctgatgctaaaagacgattagccttgctttgaaacggaagcctagtcagaaaagtaacaattccatcactaagatgttgaaaaaggctcttcaaacattttttgctctgactcacagtaagagatacatagaataaagacattttatcttagaactcagtaatgcatacacataaatacacacataaatatacaaacacacacataactttatgtatgcacaggtgtactgaaacaagctgcagaatatttatcaccactatttgatacacactgatacattctatgctcttttatttcatttttttaaaaagtaaagctgcaatccatgaaactgatttcacaacctattagtaggtgaacccaaagtgtgaaaaaccattatcccataatattaagtggccacaacatagtgttagtttcattctttatggtggttcctatttttccagattctttcccataatcctatgccatctgtatcaggtagacaaactttacagttaattttcaatgtgttttgccaataagcccagtgtcttaaattccttttgggttgctaacacagaccaggtaagcatagtcactgtgggttgaagtgccgtgctctgaccttccttcacttattttttcctttttgtatgtgttgctttttaatcagcactgtattgtgcacccacaactggaacagacagtcaacctgaaatacacattcccttccagccccaaaatgcagaaatcttgtgggacagtaaataatgctgatgtacctcttctaaacatgagtccgcctgatacaacgagcacatccaatagcattctcttccttcccctttccatatctctataaagggctactttcaattccccaaagtccaaaataagtcagccatggacagccagtgccacaccccgtggttcttattcctggcaggaggactcttcacctgttcagggctcttcaccaagacctagcagccaccttggtcctcatcgcctttgcctcatcctggcattcaggcgagttctatgtcctatcagttctattttcttttttttttttttttttttttgagacggagtctcgctctgtcgcccaggctggagtgcagtggcacgatctcggctcactgcaggctccgcctcccgggttcccgccattctcctgcctcagcctcccgagcagctgggactacaggcgcccgccaccacgcccggctaattttttgcatttttagtagagacggggtttcaccgtgttagccaggatggtctcgatctcctgaccttgtgatccgcccgcctcggcctcccaaagtgctgggattacaggcgcgagccaccgcgcccggcctcagttctattttcaaaccatatcctgtgtcagttccttggatatgccacagtttttcccgcctcaaacatacttttcctttaaccttgttcttagctctacttatccatgaataatcccttcttatcttcctaccttctgtggctctgctgaagtgcacgtcctcagaaatccttacatacacaccccactccaaacccccaccatctaaacagctcttctctttactagagtcaacttctgtttctcaattcatgtaaatgcatttatgagagtggatttattttctttgtcaatgtactctttttgtctgtgttcccaactgaaatatttgctttcaaatgtcagtggccaaaaccatcttgttcatcgtataaataaataaatacaatttataagttttacgagcttctttggttctttaataaaaaattcttgaagtgattcatttaaaagtaaaggaattatacaattatattctttctaaggattcattattttaaacaactagaaatctaactagagcaaagattagtgacagacttgaatatctgcacaaagatctgatcattaacaaactaaatagggtaattaggtatacagttggaatgcagtatgcaggcttaaattagtagtgtataattgagcctcatttaactgcaggagaatttcactgagagaattttatttacataaaagaaatgtcttagtgaaattgctttgagagaatttaaaatatgtacaccaaatctctccttacatactggatccagcagaattgtaagcttattcctcatgccccatgtgatggtgttatttctagccaaatgatttcttccaggcggctcaagatccacgctggggcttcattatttcttggatatcttgatgatactctcataaacataataggctccaaagaaggttaaataaaatgatatggtgagagctctgccccctcaatatgatcccttattttactgatcctatttttagaaaaaaactcgaagtatgtatatcttctaaacagtcacttaatttagcactgtgcaaacctttgggggcagcaggtaagtggggcaaacaagaggatccctttgtcttcagagaggcaactgccattttgaggaggcagctctgacacccaaatcaactggactgatgcaattatgtgtgaaatggggaattatcacagaagttcaggaagagacagagatcagctacatggcagattcaacttttgtgtgaggtatttggaggggagggaatacaaagaccagggtgaatattgaaagtctccccttctgcttttaggcaagtccaggtagcgaccagcttgaaaagcaagcataataaaagccctctttgacgcatctactcccgacagcaacatcatcctaaatttatctccttctatgttgtgtgttacatgggtttggtttacgtctactgtgtccatatgctcaccacccactgacatctttttccaaaatacattttaactacccaagaagcacattaatagagtcttcttttaagatactcaaatacgtgacagtgggaaatgaaacataatttctcctccccttcctctaatccactcatgatttcagaggcaaccacagttaacatttgggcagatatctgctgatccaggcctctctgttcatttgcatacacaaatttattcatataccactgcctttggtacataacattacagattgttatgtaaccactttagactatgtagtggagatttttctgcagggtatgtgtacatataccttactgtcttttatgtaactgcagagtatagatgtaccctaatttatttacttatttatcccttgattggcattcaggtttatgtataagttttcattgttggccgggcgcggtggctcacgcctgtaatcccagcactttgggaggccgaggcgggcggatcacgaggtcaggagatcgagaccatcctggctaacacggtgaaaccccgtctctactaaaaatacaaaaaaaattagccgggcgtggtagcgggcgcctgtagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaaaaaaaaaaaaaaaaaaaaaaaaaaaaaaaaaaaaaaaaaaaataagttttcattgttaaattatgcatccgtgcatttgggggtgaacgtcaaagtgtgcacttctgagtttttccataggataatctttgacgttgcaagagggattgaaaagtatgcaagtctcacacttgaaatatactggcaagttgcccttcaaaaatcaaaaggcttcaccaatttacatgcccacctatagaggtttttatttcccataccttttgtcaagaccacttattttcaaacattttattttttgttctaatctcctgtatgaaaagaatctctcattttaatttacattgatttgttcaagttctaagtaaattttgttcagcaattaattaaaacgtaattcatttcacttgtgaaaaggtgacatttttgcaatattaagttgactaatcctagatttggatatgcctcttcatttatccagggcttctattatgtcatttggtaatgacgtggagtgttctttaactcaattttgtgcatttctagctcttagacacttaatatttttattggttcagcaagaatattttatcatattttattacagattagagctactctaaagtgcttttctctgtcaggttcttacatggatgttcttatttaatatcatgattttcccaaaaaggcaatattgcccctttgtacaggttgtatatgtactcaaggctatggcaataggaaggcagggagctgaggccctttgcagcatcctttagaagtcctctcctcccctggctttcttagcgccacactggcttgtgtcctccatgcctcctctcactcctttcctgggtcttttcttggccttcttccttcactcgccttccttcactccccttcctggggagttactaaacttcagttctcatgaagggcttctcctcaacaagcatagtttggtctccaacgccctgtctgcagcttgacttttttgattttaactgactcagcatgctcacagctgagctcttatcttttctgaaacagaatctcccctaccccaactcctttgttctaccaaggccaccccaaccccataggtccctcagaatcaatacctggcatcttcttctcctcaccccagctctgttgaacctttaggttaaatttctttctgtgctcatggcttctgccccactctggttgtacctccgcttgcccatgccttgccgtctcacacttgtgccatggcccaaacccaggggagcgatttgcgtgagggcatgagccagcaagccagggcaccatcctggcacagatacttctagttgtataaactggggcaagtccctgaacttctctgtttctcaattttctcatctgaaaaatgggaataacagtatcttcctcttggggtcattgtaagaactaaatgtgtcataacataaataatgccgaaagcagtggtagcctccacctagaacctgttggctctgattaggattcatgttaatatccatgtctctatctaaattttccctttttataaggacacaccggtcacattggattaggggcacacactatccaagtatgagttcatcttaagatattacatctgcagtgactgaccctatttccaaataaagtcacatcccgaggtactgcaggttaggacattaacataaatttttgaggaagggggaaattcagctcataacgtcaggttagatgtcttctctttagggggctcttcttttctcttatatgcagctttcaacatgtgcatatttttatctggcaactcaattgctcaggaaatatctgtagctcgttcatgcctgcatgtaatcctttatatatatcatatatatgatatatagatatctatataagatatatatgatatatatgatatatagatatctatataagatatatagatatcgatatctatataagatatatagatatcgatatctatataagatatatagatatcgatataagatatatagatatcgatataagatatatagatatcgatataagatatatcgatatctatataagatatatagatatcgatataagatatatagatatctatataagatatatagatatctatataagatatatagatatctatataagatatatagatatctatataagatatatatgatatagatatatatatatcttctatttccacttctattttagttaatgctaagaggatcatgtggtttctaatgctatatacttagaacttagatttaattcttatgttcctctaatatttcagaaactgttattgaaacggctttgaagaaagctgagtttcatgacacagtgtggccatcaattggcgacggcaggcgcagctgagaaaagcttcatcgtgcttgtgctaccatttaacatcttattagcagagccatctcttctttcaattgctattaactcaattcatatagactgcaataggaaaaacacaacaacaagagctctaagatatatttctctaagtgaaaaatgacatatgcttttaaaatcttcccccaaatagtattgcctttactgaagatctaacagcttaaccacacagtaaaaagccagggagcataatgaaagaataattcatcacaatcttaaaatatgctcattttcatataagaatatattcatctctggaggagaacaaactctttttatgcagtctacatgaggaaatgtgccgaaatctaaaaaaaggtactttagctttctttttactgagacctaggaaaggatgttttgaatacaagcaataatagactgtttcatccacccatgcatgcattcaacaaatattttaggatgtcatagccaagtactgttctatgtaatggagatgaaatgttgaacaagacaaaatgagttcttgctattctagatgaaggagggaaatgttaaaccaatctcatgcacatgtacaagataacgtcacatacaggtataataaaaccaagtctctcatcatgaatgaccatgatcatgtgactttgctggaaatttgacttaaaaactgaggccaggatgacaagaaggacccatccagggagagatctgggctcagagcctccagtcagagcaattaaaagaagtacagcatggcctgggtatggtggaagaaggagagagtggagtggaagcttttggagatatggccaaagcccaaactatcatagaccatcataagtggttaggtctagtgggattccatcaaggcactaaatgatgtatattgctaaatgctcatgcatgttgaatagagattaaattgtagggaagcagaagtggacacagagagtttgaaagctacaatccttagatgtgtgtggtacagtgttgagggaggaaagtggatggattcaggatatattttggaggtagaagcagagggccttcctgttagataaaatatgatggacaagaaatgattaattttgagaacttcaggatattttttttatactcagatactaacagatatgccagggagaattgttcaagtaacatgataatgattttggggaaagtccctgagtttctgtgaatatccatttctactgtggaaaagacttctgaagataatatcttggtcagcttgggctactatcacaaaatagcatggactgggaggcttaaaccacaaaaatttatctctcactgttctggaggctgggaagtccaagatcaaggtattggcagatttggtgcctgatgggggctcccttcctggattgcagacagccgccttctcactgcgatcccacagggcggaaagagaaagtgaggtctggtcccacccttataatcacacctatacctaattacttcccaaaagctttatttccaaatactgtcatattggggattaagaattcatcatataaattttgtgcagatgcaaacattcagttcatagcagatgtctgtgatcctcctttccccaagcctttcactggggtatacaaaaatactccatggactcagtatatctttctatgtttaccaatgctctgtcatgtgacattggctcagaggtttagtaaatattttgcctgtggtgaaatagctccaaatggcagaattatgatgtaaaattcatctacatcattaccactcagatgctttctttaatatatgcggttgcctttcataagtaagcaaacaagcaattgaaagggggccctgctatgtttatgtcagtgggatcttccctgtctggctcacaaaggctacattttatacacctgtggattgtccagaacagcagaataacaaacatggcatttactaggatagataccaatttaattttttatttattaatatttttttcaattgaaaagttatatacatttattgggtacaatgtgttgattttgtatgtgtctatatatacacacctatgtgtatacacgatgtgaaatgattacatcaagatgatgaacatatctaccacctcacttatccctttttttgtgatttgaaatttactctctgagctattttgaaatatagaatacattattattcagcttagtcactctgctgtgcagtagatgcatgactatctgctagatgacataaatgcattttaatttgatcttcaacagcagaacaaagagattactcatcatctctcttttttctagatgaagaaagcaaagtttagagttaaatgactagactgaggccacacagctggaaagggacaaggaccgttttgtagttcagatccactggcttccaaagcccaggttttttcttccacactgagaaatctctcaaagtggatgagcttattgcacctcaaaccagggaaaatcttttaatttgattcttcataagaacaagaaaaagttagctgagaagattgaacaagcacattaatgatgaggactttaacatataaaattaagtatttgtattagaataacacacaaggataaaagcaggtatggggataaataccagttttcctccctgggtatcagtagccccttcatcccagggagacaaggacaatgccacttccttgattgctctccaggttcttcccttctatcctttttcctcaacttcttgggatgttcctaaacccaaaggctcaaatctgtttagattataagctccctagagataggggctgtctctctcctttttgcatttctggagcctaggacagtgctggtccaacgaatgggtgcatcacttggctctgtttcctgaccacctataacacctgctggtttctagaatcaactctgatgtgcctctttctggagatcatgcatgcctgctttctgcggctcagatcttaaagatctgactttcagcattaacaacccatagttcagcaaaatagatttctagaactgctgctattttaatatctgcctttgaagaaaacccaaaatggtgttgtgcctgagtttcagaacccactgctctatgagtgttttttgcggctcagctccgtgacaatgggaagaacgtggctgtagaactccaaatctgagggtttctgcaacattttcctactgggctaatgccccattttctttggtagttttgtgtccctacatagaaatatcccactggcccctatgctaatcttaaccaggctgactgaactgacaccaagcgctggatttattttagtggcactaacatgtaagctcatgttaactgatgttggaaaaccactatgttacttgctcataacctatttactcttagtttatacaaagtcctaaaagccttgatatgtctgttttctaactctcagcatactgaatgcatcacactgtgtgttgacaaagatactgataacaaagggaagtaacatataacagctggatagtaaaggaggaagcagaaaagctaataaagacaagctcagagacttgaacatctggcagtctgggaccattccatgcatcttgagatgccacatagcttctgagacatccctctggtaactgagcagcatggctcaataatcgatgtccaaaatgatgactcaaaatccaaaaatcattccctgttcagtaggctctaaattgcagtgtgtctaacatgacaaaaagtatgaactatgttttagaactgtgtccggttaaaatgctaatagtattccaaggaaaataaaacagaaagacacacaaagggagacagaatgagacagaattgtgtgtttgcactttttgctgccaataaattgtatttaaacatttgcctattttaacagaagcacatccattaatcccattgaaggacatgaacaaaccatttaatccatatgacatggaaacctttggtggcataaggtagcaagtggggtacagtggcaagttagggagcagttaaaatgattccttgttaccacagggctgacatatttggtgctctaatgacttagctgtgtccttgttgtcccttgatagttccacaggactcctgagttgagactgtacccaaggaccctggacttacctgttcctctcataattaaaagatcctacttttcaaccttattttatgttttaaaatgttgatcaatttcaagatgagataaattgagaaatgaaggactagacaaaggaggtcaaattaacccatttatgcctgaggttgcaattttttaaatttttgcaatcagaccttggcaatgaccttgagcagcaggaaataaataattgccacatgcttagcgttccaataatgaaacgctaggcttaaatgggtttacgcacagaaactcagttaatgtcaactccttcattcctgtaaacatctcaaaaaatgcttaagacaatcaaaggttcaagttcttctgaaatgatacgccctaaagccttatttaacgtaagtgggtaaacgaaaaaaatgttagatattacaagaacaaaatgttcctagagaatagagccctctctggaatcagtaataatgcaggctgctgctatctgtgtgcatttctcaacctttctggaaaatggcacacaaaatccttcccacttgtattttgccaccactcatggcctatcaattctaatgaaaatactccacgctaagaaggtgacaggaattacatacatcatctttttttttttttgactttcctttctgtctatcaaactgtactttaaaggaactgattattaaagcattatgtaagtatgcaaaatatattgaaagagaaataatgtttccattatacacaatgtgtatcataagaaaggctggtgtgtgatgacacatgacaagtggtaaaaggtatttttagttgctttcattttggggaataataaagcaaaattatctggaatatacagcattaggagatttttcagcttctctaatagctagcattatttatggcatattttaaactaaatgtctaactggaattgtttggaaagttaatatagatattactttaaagatattttatactacctttaataattaatttgcgctcctttgaaaagcttatacaaggtcagtatttgctctgttattttatgatctttttcacatctgtgttctttggaattactcctaactcatgataattcataaatcatttttaggctgggcatggtggctcatgcctgtaatcccactttgggagggattacactccctggcactttgggaggccaagacgggtggatcacttgagctcatgagttcaagaccagcctgggcaacatggtgagatctcgtctctataaaaaaatacaaaaattagccaggtgtgatggcccactcccatagttccagctattcgggaggctgaggtggaaggattgcttgagctcaggaggtgatggctgcagtgagctgagatgataccactgcaccacagcctggataatacagccagaccttatctcaaaaaaaaaaaccataaaccatttttaatttatctgagaaactgacctatgcatgatgtgtagttactgcagaaaatgaccaagaaattatctttacaatttaaatatgtaaagctcaaaagcaatgaagctaagactcctggaaattctgactgaaataaactaaaggatgtttcaactgaacctgagaaaaataagcaataaaagttgattatttggcattttagtcttttttcaaagataaaaatcacattctttctagtggaatcacatcacatgcagaaatagcccatagaagagtctaacggtggcaggaggtgtactgagttacccaccgggaaggtgcaatgaggcactctcagctctactttttttttttttttaaagtaaaagaccagaaattttattatcttagggaaattatagaatccacttacgatgatcatttacattttacctttatgctccaacttgttttatcagccaattaaaattgaacagcgaaaaatatctttaaaagttacattttcaaagggaaaaaaacatttttgccctcttaaactaacactgatatttgatctcaatgttggccctttctgttcaactgaagctttaccggtaaaaattagaggttacagataggacattgttttgtgctgacataatggggaatgactgatcatgaattttttttcttgaggtgaaaattgttattgttagtgatttgaacagtccctttaaaaattagtgattaagaaataacagagtattctaaaacactgaatctgggaagaattgatatgtgtcatagaatatagtgataaatattggttattaatgtgaggaaataagacagcctttttaggggaagtttgtagaatattttattgctttgtagtctaatatttttgtgcttttattgaaacattttaaactgaggcaaaagtttatactttcataagctagagatgtgcaacaaaaagttaatattcccttaatttgtcacattctaagggaaatgtaatgatccaagaaaatcttctgtgttcggtatataccaattatatgacaacttcgttgctgtaagataaatgcatgatctaaaaaaaagtttatgaggttagatttgctaagtatatatttattgtatagcataaggactaaaaacccttaatgtaggctagtcaaaaaattaaaacagcttggacccttaattgacacacacacacacacacacacacacacacacacacgcagacgcacgcacccatttttagccttttcattaagtttcttcaggtgggggaaaaaaaaaactgtttaaggactttgtctgtgtggttgggttgctttcattgtcttttaaccaagccactgttttcctctatttcaggatctagatttctcatcacatccacgggagccttgtatattaaagatgtacagaatgaagatggattgtataactaccgctgcatcacgcggcatcgatacaccggagagacgaggcagagcaacagcgccagactttttgtatcaggtaaaaacttatcaagactctgtctgctatgtctgctatttctttgttagtgtcctgagacgactcaatcaaaattgtggagtgttgccactaaaatggagccttcaattccttttccaaaatattttaggaattttaaaactcttttaaatgaatatgagtacaatttcatagaaatacagatttcacatttgtcaaaccagtaattgacacattcacataatgatgcgttagcatttcagggagcacattaggagtgaaagatccatctccatcccaaatatccatctcaaatgcagtcaaattgcatttgatttgattataaaaccaaatacaaaatacccaacctttgcctttgtagctgaagaatataaaattgcccccctgtggtaaatatcctataaggttgtaatagtgagatggaagtgaccaaaggttgcttgctatcaatatttgagaagtaccttatttgtaataatgctttatgggaagaagtgaagggaacttgttgaacattggaataatttaaaacatcactgcctgagcacccactttttgtccttgataatgtactgttgggatttttctcttcatcacttacatcttcaaaatagccaatagtctttcaaggtccagcacaaatacaagtcagaattaaattagttttcctttgaacttgcaagtatttttgtttctttatctgttcttttacaagtcaattgctattttctcccttgcttttatagttatcatgtcttttgggggaaaaatgaattagaaaatgaataataactatcatcttagtccatgatagctttaaggagagcacaatattctgcttattcagaaaatcctagaaaacgtcctctttgtgttaaagagaaattttctaatggcatgttcagaaaagaaaggggaaggattcgaggtaggagggggatcctgatataaaattaatttgggattcgcaaaattagtaaataagcatttctccctccaaatgatgacataagtggtgatgatctaagagcccgtctttctgtttcaggtgaccttttttatcttcatgctgaatcatcaagtgttgatttttaaatgtatctctcagggttggaaaggcaagtttactttccttaatcccacgatgtttgttcattttttgttttggagtgattcactaatgtttcaaaaatggacagaagtagtcacaagcattttgtcaccatgggagtcctaggattgcctagtgagcattggaaaagtgagagcaacaatgtataatccagccagggaatatcatacactaagccacctgccgaaaagtagccaaggaataagactgagcattcaggactaacagtatagatgaagacagggaggtgatagatgccaggagaagggaggggtccacagagtcacatgccacaaaaaggctcatatgagagtctaccatatgtggaaaataactcaatattttttgtcattgaaattttaataaagcagttgaggaagaaatttgttaatgctaaaagatgagactgtagacactgaatacagaatgcatttctaacatgtcaagctttgaaggaaaagagaaattaatttcattttaaattagatttaaatatactgaaaaatgtacatctggagtttgggtcatggtggaaacatgttggtgtttgaccccaaactcctcctgaaaccaacacagataaaataggatgacaaagaaaaaagtacatggatggcaccttcaacacaactggattactggcaacaacaggaccagcagcagaggtggaaggcagtagaaggggtcagcctgttgggtttatggtagtgtcagaaaactgcaaataaccaacgggtccccatctccaaaagcagaggagaattctttgtgtcttagagtcctcacaacactgggatagaactgcatgaggtctaggttggagatgagtcacaaggccattagagtggctggtaatgtttgcacaggccagtgatggtctatgtccttgaagatagtggaagtactcagcaagtactcctttcagaagaacagagactcactctcaggggaacggctcaatttagaaatcaaattgagccagagtagaatacaaagagtaacagagaaggctcgggaaccaggggaggccctagagaattccatcctatgaaatactgcaaaagaaaatacaacacgcacagccttagaatgtaaaaaacagtgttctaggaaacacatggccagaagtggaagcccatacagttcaatcccatatagctctgagagatgggctaaatgtcgagtccttgaaggtaatatcaagggagaagactggaaaaatatactcatttcatcctctcctgcaggaaccttctcctaattaactaagaatctctatcttattgtaaaatgaaacaaaaaggaaaaagatttaacccaacacaactttatcacaagaaaaagaatgaaaatttttaaaaaagttttgattataagtaactacaaaaaatactgacaaatcatatgaaaactatatttttttgtttgaaatgattaaagctttgaaagagcagtataaatcagaaataaaatgatgaaacaacacaaatctgtgaaacaaaaagtggcatattttggaaaaagttagaaaaatgaagagttctaaaattaaaatgaaatgacagggaacacatcagaggataaacacaacagaaagcataatatgggaaatcaaaaatattaaggaataagacaaatagagttaaaaatgtatagatgtctgacaaagatgatgaaacacatgtataactaaattctcttaaaaagaaagccaagcaattgatgagaataagtattaataataaaacactaattcaaaaaaagtctcctgtcattaaaaagaatgcataatgactacatattaaaatggcacaaccctacctggaaaaatggacccagaatggtcaacatgcaacatagtctaataaaatttttgagctgtaaagataaagaaaaatatcatttagacagccagaaaataagttcaagttacttctaagggagaatataaacagactaatgaaatagaaaatagaccaaaagaacagtaaatgtaataaacaagttttttctttaaaaaaaaagtcagtaaaatagacaaactgacctaatattttttaaaatggtcttgatttctgtgctagggctagttatttggacaagtcattctttctctgaggataactagaaagacttgttaaatgtgtaaaaaacatctgctcatggctgttaggagctagagtgaaaacttacaggaccaaattccagaggaaaacagccacaagaagtgagtttggtattgaggactgccttttcagtagggacagttttagaggagattgctgaaactccgagaagatgagcaactcttctgaaaggttagtagtgtctagaaggtaaaaattggagtctagtctctatatatgtattagggttctttagggggacagaattaataggatagatgtatatataaagtagagtttattaaggagtaatgactcacgtgatcacaaggtaaagtcccacaataggccgtctgcaagctgaggagaaagaaagtcagtctaattcccaaaaccttcaaagtagggaagccaacagtgcacccttcagtctgtggtcgaaggtccaagcgtctaaaagttgaagaacttggagtctgatgctcaagggcaggaagcatccagcacgggagaaagatgtaggctggaggactaagccagtctagtctttccatgttcctctgcctgcttttatcctagccatactggcagttgattaatggtgcccacccagattgagggtgggtctgcctctcccagttcactgactcaaatgttaatctcctttggtgacaccctcacagacacacccaggaacaatactttgcatccttcaatccaattaagttgacactcaatattaatcatcacattaaatatatttgtttatatattatatattatagatactcatttttatttatagtagcatatatagtgggataagtgaaaagtgattatgtttatgttatttttatttttattttcagtataagagaaaaataaaagtatgaaattcttttataattcttgaaaatttatagaaattcttgaaatataacaaaaatgtaaggcatttatacaactgaaataattatttctaaatactttacatatgtactttttatcctaagctctaagagaacagatgtgccttagtgtgtatatatatgtatgtgtgtatatatatatatatatatgtatatatactagtgtgtgtatatatatatatgtatatatactactgtgtgtgtatatatatatatatatacacttttttttaattgtactttaagttttagggtacacgtgcataacgtacaggtatgttacatatgtatatatgtgccatgttggtgtgctgcacccattaactcgtcatttaacattaggtatatctcccagtgctatccctcccccctccccccatcccacaacaggccccggtgtgtgatgttccccttcctgtgtccatgtgttctcattgttcaattcccacctatgagtgagaacatgcggtgtttggttttttgtccttgcgacagtttgctgagaatgatggtttccagcttcatctatgtccctacaaaggacatgaactcatcattttttatggctgcatagtattccatggtgtatatgtgccactttttcttaatccagtctatcattgttgggcatttgggttggttccaagtctttgctattgtgaataatgcctcaataaacatacgtgtgcatgtgtctttatagcagcatgatttatattactttgggtatatacccagtaatgggatggctgggtcaaatggtatttctagttctcgatccctgaggaatcgccacactgactttcacaatgtttgaactagtttacagtcccaccaacagtgtaaaagtgttcctatttctccacatcctctccagcacctgttgtttcctgactttttaatgatcaccattctaactggtgtaagatggtatctcattgtggttttgatttgcatttctctaatggccagtgatgatgagcattttttcatgtgtcttttggctgcataaatgtcttcttttgagaagtgtctgttcatatcctttgcccacttgttgatggtgttgtttgtttttcttgtaaatttgtttgagttcattgtagattctggatattagccctttgtcagatgagtagattgcaaaaattttctcctattctgtaggttgcctgttcactctgatggtagtttcttttgctgtgcagaagatctttagtttaattagatcccatttgtcaattttggcttttgttggcattgcttttggtgttttagacatgaagtcctttccctaaattttaaaaaatgcataaaatccttgaaatgtcaaattccaatagaaactattggtatttgtggtatgcgtggtggctcacacctgtaatctcagcactttgggagaccgaggcaggcagaccacttgaggtcaggagttcaagaccagcctggctaacatgatgaaaccccatctctactaaaaatacaaaaattacccaggtatagtggtgggtgcctgtaatcccagctactcaggaggctgaggcaggagaattgcttgaactcaggaggcagaggttgcagtgagccaagatggcaccattgcactccagcctggtgacaagagtgaacttccatctcaaaaaaaaaaaaaaaaaagaacacaaaaaactattggtacacacttcaaaaaaaaagtatgaattttcagtctttccactgagaagtcccagaagtgatgagcaaacaatagcaacaagcccctctaacatctagattgtagattcttttaaatataattcactactaaaagggaccatggcttcttggaggagtggctgattgaaggtctgaggcaggaaatgtctgaggtgagtctgaaacatgaatggggtcttgtcaaaatgacataggaatcaacataaagcggctctcgtcagccaaaggggatgaattgagtatcagcagtgatgcttgcacatgattgataaccattaaatattttgaaaacctttgagttcattttaattttatacatacatgtgtgtgtatatatagatatatacacatatgtacatatatacttacatatgcacacctgcatatatatttcatataaagaaagaaagaagaatcttattggtctgcatagtagaaaccagggcactaactcttcattctgataacagatgattaaagacaacaaccactaaatgtattgtctttcctatagctgctgtattttaagataaccaaataaccttagttcagaagggaaagttcattctgcagaataattatatctactgaatgcgaacgaaatgacacaattagaaaattccattttcaaccttagcaaaatagctcagataaattttaacatctgacctcactgaacaattgagtgtcactaagaacgggaaaaccatacattttgtggaagcaatgtgaagtgcacagcacccctctcaaagagagagaggttgaacacttatctaaccaacccactgaaataaattccagttcataagaaaaatgcctatggcaataacggaacaagttaaatgatgacatggacaagcaaattcagcatggtaactacctggtttctttttttttattattattatactttaagttttagggtacatatgctgctataaagacacatgcacacgtatgtttattgcggcactattcacaatagcaaagacttggaaccaacccaaatgtccaacaatgatagactggattaagaaaacgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcatagatgggaattgaacaatgagaacacatggacacaggagggggaacatcatacctggtttctttaaaaagccaagtcaaatacatgggagaaaggaggagggctagctctgcattaagaaacactcaagagatgtaacaactgcatgtgagcaagagaaggatcttgatttaattaattcaattgtttaaaagctagccacttttgagctgatgaggaaaaatgaattgggagtgtataatacttgatattatgtaatactgactgtggttatgtaacaaaaccgtatttttattagggaaacatgctagtcatgtaatgataaaatgacatagcttcccttttttgttttttgttgttgtttgtttgtttgtttgtttgtttttgagatggagtctcactctgttgccacactggagtgcagtggtacaatctcagctcacttcgatctctgcctcccgggttcaagtgattcccctgcctcagcctcctgagtagctgggactacaggcatgcaccaccacacccagctaattttttgtgttttagtagagacagggtttcaccatgttggccaggatgggctcgatctcctgaccttgtgatccccctgcctcggcctcccaaagtgctgggattacaggcgtgagccgctgcacccagcctatagtttcccttttgttgcatatactttaccaccaaaaacaaagtaaaactatcaagaaataaacatgacgaaaaatagaaaaggtttggtgccagagccattaatatgatgaatatatgggatgcgtcatattatttttgtctacttttctgtacgttttcaaatgtttggggtaaaaataatttttgtaatatatatatatatataaaagtttgaagactttgagacaaaaaaaaatttgaaggggatgaaaatgaaagacaatgccgttcggttattcagatttgatatatgaccaaatatccccacaagagcctgtctcaagcattgcttcaatcatgcacttaaaatataaaacatcagatgctgtgagggtgcagagaaaagggaacacttatacactactggtggtaaagtaacttagtcctgccattgtggaaagcagactggagatttctcaaagaacttaaaatagagctaccatttgacccagcaatcccattactgagtaatatatccaaaagaaaataaatcattcttccaaaaagacatatgcacttgtatgttcatcgctgggctattcacaatagcaaagacatgaaatcagcccaggtgtccatcaatggtagattggataaataaaatgtggtacatatacaccatggtatactggaaagccataaaaaagaatgaaatctcattctttgcagcaatgtggatggagctggaggccataattcttagtaaattaacataggaacagaaaaccaagtacctcatgttctcacttataagtaagagctaaatattgaccacacatggacacaaatacaggaacaatagacactgtggacactagactgtggaaggcagagagtttaggttaaaaagctacctatcaagggccaggcacagtggctcacacctgtaatcccagcactttgggaggcctagatgggcggatcacaaggtcaggagatagagaccatcctggctaacacggtgaaaccccgcctctagtaaaaatacaaaaaaaattagccgggcgtggtggtaggcgcctgtagtcccagctactcgggaggctaaggcaggagaatggtgtgaaccccgggaggcagagcttgcagtgagctaagatcacgccactgcactctagcgtgggcaactgagcgagactctgtctcaaaaaaaaaaaaaaaaaaaaaaaaaagactacctatgaagtaccatgctcactacctgaggaacaggatctctactccaaacctcagcatcacgtaatattcccatgtaacaaatctgcacatataccgcctatatctaaaataaaagttgaaataaaaaaataaatacctcattcaggtttcgtaaaacagttttgttgagaggtagtttactttaatataaactccatccggtttattcaattcaataattttagtaaatgcatggagtcgtgccacaattacgccaatttaattttagaatattttcaccacccaaaagattcctcctacccgtttgaagccaatttcaatgtccatccccagtcccagacaaccactaatctatggtctgtctctgtagagttgcattttctggatatttcacataaattgatatatggattttgtgtctgccttctttcatgcagcacccatgttgttacatgtattagtcattcattctctcttgttgctggagagcatttgctcatctgtaaatactgcatttggttatcaattcactaaattatgaatatttgggttgtttccactttttgattatgaataatcctgctatggacatttgtacctaagtctttgagtgaacatgttttcattcatttagggtagatacctagaacttggggccttatggcaaattgaagtttaaacactttaagaaaatgccaacttgttttggctgcttttatttggcaagtataccacaatacacctggggaaaaaataaactctagccaatgtgatgtaagaggagaaaaatgtgtgggtttgtaggaaattctgcttaaaagtgacttcactgagggggcattcttaagcatttttgctgtgatgtggatgtgaaggctggcactccagcaagccatttttacgtgagatgtatatgtgtgcatatgtaagtatatattaccttccaccaacgatgtatgaagattccaggtccccatatcttcaccagcattgtttgtgattttattgcagtcatcctaatgggtgtgaagtcatgtcttactgtgattttaattcatattaccctaatgcctagtaatattgagcatctttttgtgtactgattaggtatttgtgtatcttctttggtgatgtaaaatagtcaactattttgcccattttgattgggttgtttcttttcattatagagatataagcatttttaatattttttggatttgagttctttattagaaatatgattttcaattttttttcactttctaaatggtgcctttgaaaatgctacagttcttaatttttttttttttttttcgagatggagtcttgctttgttgcccaggctggaatgcagtggcatgatcttggctcactgcaacctccgcttcccgggttcaagctattatcctgcctctgcctgtagctgggattacaggctcatgccaccacacctggctaatttttgtatttttagtagagacggggttccaccatgttggccaggctcgtcttgaactcttcacctcatgtgatctgcctgcctcggcctcccagagtgctgggattacaggcgtgagtcaccgcactgggccagttcttaattttgaagaagtttattatgttgattttttctgtttttgcttgttttcttagtgttatgcctaagaactcttcaaggtcatgaagatattttccctatgttttcttctaaaagtttttatagttttagctgttatatttaggccataatccattttgagttaatttttgtaggtagtgtgaggcaaggttctaaattattttccatgtggatatccagttgtctcagccattttttaaaaatgtcattagaattacatagcactatcttaagcatatttgagaaatttctgccaagtttcagttagaataaaactttttaagtgcagtcattgagagttgattttttatgaatagcattagaagttggtgcatttcattttcagagattgtgggattattctgcaaagaaagtcagaggtgcacactgtggtgtttattgtcagccacccctgccaaaggggtgacatctttgtgccaccttctccaactctacttctacttcctactctaagtaaaatgacagattttgcagctattttttcatagtactttctaatatcttcaatattccactctagtgtaactaaaatctgtattactgaagaacgagagctatcattatattctcacattttttgtttttgtttttttttattatactttaagttttagggtacatgtgcacaacgtgcaggttcgttacatatatatacatgtgccatgttgttgtgctgcacccattaactcgttatttaacattaggtatatctcctaatgctatctctcccccctccccgcaccccacaacaggccctggtgtgtgatgttccccttcctgtgtccaattctcacatttcttaattaaatgaagacagagttcagaataatagagaagcttaccccaagtaatacatattatcttggatgtgatttctacttactaaacaatattgcaatggtgtttatatggtctgcaagttagtgtactaggaattaaaaaatcccatgtggttaaggatgtccaggaccatttctggagctggctttaggcacaactttgtgtcttctagttcactgaacccattgggtgtgcaggtgatgatacttccagtaacatggatgcagacagctaaccatttttctggattcttggttcatgctagaagatgccagagatcagtgagacatcattggttaggcctgtctccacttaattattcagtctatgggaacataacttgatcttcaaaccaatacttttcaaagtccgtttgtaatttcctttagaagcaggtaaatgaagcaatgaagtttttgctggcacaggctctgtacctgggtattgtgaaacttttatatctctcttgccttctggagccctatagtcatgcatatgaatgactgtaattctggaatatagaattcttcagttaatgaagaattagaggagtcctggaagctcatcaagtattctttaaaagagtatttaggttccctcattatatcactgtcataagacaccagtgaagtaaaaagagcagcaagttcataatgaagttttatctctgatgatcacaaaagaaatagaaagccaagacatttcagctaaatgtttttgttctattttcaacagtgcctgctgactgccctcagtggctgactacggaatcacagcctcttaaagaagtcttcctactaataaatgattttttgatgttattgtttattaaaacagaaatttactctcttgtatataagtccagaagctggtttgccagcttcagtttcacaagggaccaggcttttatctttctgatccattatcctcacgtgcagttccattctcaatatgatttcaaagtccaaagtgattgctgcagctcctacctttatatccaccttccaggtgatgtaaagaagcaaaggaaaaatgcataaaaacacccctcccagctaagtcgcctttaagcagaatttcctacaaatccacacattttcgcctgttacatctccttggctagagtttatttttcctccaggttaattgaggtattgaaaaatgaaaattgtatatatttaaggtatacaatgtgatgtacaatgtgcatatatatatatatatatatcactatcaagcaaaataacatatctattgcctcacatagttaacatttgtgtgtgtatgtatgtatgtgtgtgtatgtgatgacaatgtttaagatcaactgtctttgcaaatttcaagtatgtaagatagtgttattaactgtagtcactgtgctgcatagtaaacctctagaatctattcatctggcataactgaagctttgtacccttttacctaccatatgatctagcaatcccactctgggtatatatccaaaggaaatgaaattacatatctgcactcccatgtttattgcagaatcattcgcaacagccagaatatgaaaaaaacttaagtgttgatatacatatacacacatgcataggaatatcattcctatatacacaaaggaatattattcagccttaaaaaaggaagcaaatcttcccatttgcaatgacatggatgaacctgaagggcattgtgcttagtgaagtaagccacgcacagaaagacaaacactgtcttttctcacatacatgtgaaatctaaaaaagtcaaactcagagaagcagggaatagagatgttcgtcaaaattacaaagttccagatggctctcatttgataggacagtgaatatccattccttggccatcagatttattgcaggtagatcaaaagagtcatggcatttttctcactgaggcaaagacaagaaaatttcaggtagcaggagtctataacgtttctgtaatatccatgtggaatgcaagggtattgtttcatgcaagttctaaacaggttgaattagaagagagagcagggtgagaacactgagttttacgtttagcatccaatcaggtgctgtattttatattcttcatagtcatgcaaagattatgaccttgggaacatcactccattcaaacaaacttgaaggacattgagctgcgtggtttccacagacccagttcttgagaatattttatcaatttcctcacctggttcaagatgatgtcacagaacaggaaaattatacaaggccctgtcataagtgatcatttgcaagctgctgctttttaatccattgtcttgctacgccacatgctgtcggtagtgctcattcaccttatctcaaataccatcttctcagagagtctgtccctgaggaccatatcttgagtcctcctggctgcctccacacccatagcacgtggacttcactctctgttatgccctctttttctttctttaactacacttattacaaactaaattatctttatttgcttgctaatgtgttgcttgctccccaacaccacccgcccaacagaacatgagctccaggaagacacctgtctcatccaccactctccctttagtccctaactctgtgctggtctacactgagggatcaaaacatatttgtgaaatgaataaataaaatgttttaaaattcaaaagctatgtgtaaaactcttttgtgcaataaattttactaaagttaaacagctatttctgcttatgttgctctttttttttttttttttttttttttgagacagagtttctctctttcacccaggccggactgcagtggcgctatctcggctcactgcaagctctgcctcccaggttcatgccattctcctgcctcagcctcccgagtagctgggactacaggcgcccgccaccacacccagctaattttttgtatttttagtagagacggggtttcaccgtgttagccgggatggtctcgatctcctaacctcgtgatctgcctgccttggcctcccaaagtgctgggattacaggcctgagccaccatgcccggcctagtgttgctctttttttctgtttaaatttatttaggctgggtgtggtggtgcatgcctgtaatcccagcatgttgggaggcccaggcaggaggatcacttgagcccaggagtttgagactgtggtgagcaatcattgcaccactgcactccagcctgagctacagagtgagccactaacttaaaaaatatttattttattaattttatgatattttattgatgcataatagatatatagtttggggtacatgtgataatttaatgtattcatataatttgttaaaatcaaatcagtgtacttgggatatccatcacattatatgtttggcttttctttaagctataattatttcaattcttctgttttagctattttgaaatatacaatacataattgcaaaccatagtcattccactgatctgtctaccactaggtcttatttcttatctcaaattgcatatttgtacccattaaggatcttttaaagagaattctgacattcccagttatgaaaagacaatctgatttttggcctgagctgacagctcttgttgaagcctgctcattctggatcttttattcatttactgaggaatgaccaacagaagctctgaccagtgttcaaccttttgtaaattctgagcagaaaataaattgtatgaatagggcacttctttttctgttcacttataaaatcttaaagatctgtatcaatagttggtatgatgcaccgtatttaagttatacatgaagtcctacaattctaaatgaccacttcaactcctcattcctgcctctaagagtttttatttcttctacagacccagcgaactcagccccatccatactggatgggtttgaccatcgcaaagccatggctgggcagcgtgtggagctgccttgcaaagcgctcgggcaccctgagccagattaccgctggctgaaggacaacatgcccctggaactttcagggaggttccagaagaccgtgacggggctgctcattgagaacattcgcccctcggactcaggcagctatgtttgtgaagtgtccaacagatacggaactgctaaggtgataggccgcctgtacgtgaaacgtaagttggacggtaacttgcaaaggtggtgttggcttccatcgatggagctcctgttataagcaaatctccatgttttctctgtagctttccattaactcccaaaacagtccagctgagatcaacagaaacctcattttacagatgtgaaaattaatgctcagatgaattccccaaggttacacaactggagagtcttggctgtcggatttgatttgaaatctttctgatccccaaacctctgtgatttccattaggccacagactattacatttccaagatatgatttcaagataacacttcctagctgatgaattcacaacaaccagtctctctaaaaatgaacagagagagagggtaggattgttctttcagcacaagtgatggtagccaatcaaagcagttgtcctttgtctgtttccagaccatttctccattaaatttctaaatgaggctattatcacccaaagtacggggctcaaacatacccaaatattagacttgtgcctagtattatagatcatctactccaaatataatggatttatttgatcttctattgattgccttggctgccttgaggaatgtgttcagaaggatactgaaggcagatttggaggaaggagggatgtgatcgcagggtcacaatctaatctactcaaccaccctcaattttgctcttgcagaaaccaaattaaagtgaattacccaagatcacatggccagaaaagggaggcagagcattggtcagagaggaggtcttagttgccaatataatgctccttttttgaaaatatatttttatttgatgaactaaattgaacaaatttaaccacaagaatctcacagtgacaatagaagtgttttcttacttcctcctccccacccagccctaaccctgtttatggaactttctcttcagtgtcaacctgagtgtagactgccttagcgcaacaccagcctaagagaatatatttatattaaatatccaaatgactctctatctggaacaggctgtccagcctgaatcctgcaaatatttgaatatgtttagtctgggattagaaagaaatggatgataaaatccacagtcacacttctatagctgaagaatcatgtggataaaataatgcagcattggacagccagtaagaattattcccacgggctcaaagtctcttctgtgtttaaagacctctcctagctccctgttctccattgaataaagtttatatcttaggatagtactgaaggcatctcaagcaaatctgtctggttgtatttcccattgttttgcattaaaacccacttatgactagtgttccattattggaacactaagcatgtgggagttatttacatcctactgtgcaaggtcatcaccaaggtctgattgcaaaaattcaaaaaaaattgcaacctcaggcataaatgggttaataaaaacctattcctgctaaatctaacttcttcctaatccctgcacaaacctattcctttcctgattgcaagtcacattacttatgttgcttcctccacatggaagattatttcccaatacttggttatctaacacttcccaactctcttagcctccatccacaaagatgtgttgttccccattctcctgtctccttctcaactcagagtatgttactgctttctctctaaaggcgtttatcactacctatattttaaaagcctttattcttaatgtgcttatttttatcattgttcccttcttccacatctaggtgattctccaatgcttctggaatattctctgcctcccttctgactgcttcttctaactgcagaagaaaacagcttcttcgttcctatctctcttctctattggaaggcattctcttgggctccaaattcagaactgtcttcttgtcaagctcttcccttttccttaggctctgtttcatttgtagagcttcgaattccttgcccctgaaaataagctctgaatctgtacttacagccttggcgtccttcctgaatgtcagacaagtgtgtcaaccagctttctttcagaaatttagttggcacttcaaaacaacagggtcggataccaaactgaactctccaccacctcttccttccaaatggctcttgttattattatcaacatcttcctccttctcatccctcagatgcaaacatgaaatgttgggtgccctttaagcctttcctttctacatcctgccaagtcctgccatgtcctgccaagtcatacaaactgaatctcacagttactcagctctgttctcaacctctgtcctgtcctagattggatcttaattgtacctacactagacatgtgtaatgtcttcaatgacgggttttcctcaccctaatttgtcaaaagacctatgacctagtgattccattaaaagtatgtttgtgctgggtgtgatggcttgtgtctgtagtcccagctacccaggaggctgaggcagaaagggagaggagtttcaggctacagaaactcctctgtatgattgtgccactgcactccagcctaggtgacagagcaaggccccaattctaaaaaaaaaaaaaaaaaaaaaaaaaaaagtatgacttatttgctaaacacttttgaatgccttctttagttatctttgtttaattccaaaatctcagggactctctgttgcatccaaaatgaatcagaaattctcagacatgcccctgctccctgccttaattcatgtggttcccaatctctgtgattccctctttccattctgactgatctcagttctatgcacccttgatatctgtggatttcctgctcttcccatccaccctcctccacatgtgctatgtctctaatggcccctccatcactctggttggttattacagccatttattgcctttgtcttatcaacctagaagactgagctccttgaaaacaaagtgtggtgagatgaaaagttaggaacaactggggtaaaaaaaagcttttttttcacccactttttgatggggttgtttgtttttttccttgtaaatttgtttaagttccttgtagactctggatattagaccttagtcagatggatagattgcaaaaattttctcccattctgtaggttgcctgttcattctgatagtttcttttgctgagtaagtagaagcttattagtttaattagatcccatttgtcaattttggcttttgttgcaattgcttttggtgttttagtcatgaagtctttgtccatgcatatgtcctgaatggtattgactaggttttcttctagcgtttctatggttttaggttttacatttaagtctttaatccatcttgagttaattttcgtataaggtgtaaacaaacctgtaggttcagcgcatgtatcccagaacttaaagtgaaataaataataataataataataggagaagattaccagaatggattaaaaagcaaatcttagccatctgccatctacaagagatgtttgttaatttaaaagatatatttatatgtcttctggcctccatttgcttctgctaaacaatcagaggtcattcagatctttgtttctctgtatgtcatttgccatttttgctgtctgctttaaagaatttctctttatttttcgttttccataatttgtaatatgactagacaggattttcatcagattttctctgctcagcactttctgacctttaaaaatctgtaactgtaggtctttcaccaaaaattttgttttgttttgttttgatttgccatttacctgttgattggatttggctgagttatttaagcgctctcaataactattttctgttttgtaaaatagagataacacaaaaattacaggattaggagaagactgacttaaatgatgtatgaaagatagtcgataattttatagcacaagctagctgcaccacaaatattattccatttttcttgcctgtgagtttaacctcatccttggcatatgacagatgctcagtaaatgttttctacattggattaaggttgttgaattgaaaacatagcaaggcgaggatgagagtttcttccctgtctaaatcactcagccccattttaaagaaaaactctgtttcgtggtcacaaattctaataccaacctgtttttgttttttttttcctcacaattgtgtgttattggccctgggtaaaccacatatgtcatacatgtgtgtgagaatggcccagggcaaacccaccagtgccaccttgggacaaggcaaattaggatttatatgatcaatacttaggtcactattggtagccagcatgttgcatttctttttttttttttttttttgagatggagtctcactctgtcccccaagctagagtgcagtggcgccatctcagctcactgcaagctcctcttcccaggttcacaccattctcctccctcagcctcccaagtacatgggactacaggagcccgccaccacgcccggctaattgtatttttagtagagatggggtttcactgtgttagccaggatggtctccatctcctgacctcgtgatcctcccactttggcctcacaaagtgctgggattacaggtgtgagccaccatgcctggcctgtatctcttattgtcagtggatttatatcaacatcctcacagagactcctgagaaggcagtttgaccaacattattgcatttgttgcaaagagaaataaagccagaaataaaaaatagcgaagaggatgttcccaaacaaaatgctcctctgtgaaataatgtggctgatacgaactgcatgcagtatgatagcaaaaatgtggctgataggaactgtgtggagtatgattgcaataatgtggttgataggagctgtgtggagtttgattgcaataatgtggctgataagaactgttaggagtatgattgcaataatgtggctgataggaactttatgggatatgactgcaataatgtggctgataggaactgtgtgggtatgattgcaataatgtggctgataggaaccgtatggggtatgattgcaataatgtggctgataggaactctctagggtatgattgcaataatgtggctaataggaactctctggggtatgattgcaataatgtggctgatacaaaatgtatggggtatgattgcaataatgtggctgataggaactctctggggtatgattgcaataatgtggctgataggaaccgtatggggtatgattgcaataatgtggctgataggaactgtgtggggtacgattgcaataatgtggctgataggaactgtgtggagtatgattgcaataatgtggctgatgggaactgtgtggagtatgattgcaataatgtggctgatgggaactgtgtggagtatgattgcaataatgtggctgatgggaactgtgtggagtatgattgcgtgatgcacttgctttgttgaaagtccagcctgttgtcgaaatgctatctagtgatgtttttatcttttttctctctctcttactaaaacctccagagccactgaaagccaccatcagtcccaggaaggttaaaagcagcgtgggtagccaagtttccttgtcctgcagcgtgacaggaactgaggaccaggaactctcctggtaccgcaatggtgaaatcctcaaccctggaaaaaatgtgaggatcacagggatcaaccacgaaaaccttataatggatcacatggtcaaaagtgacgggggcgcataccagtgctttgtgcgcaaggacaagctgtccgctcaagactatgtgcaggtggtccttgaaggtcagtgggcctcgtttcagggtatggctgaaaaagaacccaaacccagagcactcagaaaagaagaagacagggtgaagcagtgctgatcgctcagttctaggctctctgtctcaccagctagtactctaccctaatttttcaagctaaatcaggcaaatgggagagaaagttctgacgaaaataaaattgtttcatattagaagtaatgtaaagtaacataaatgttgcccacttgtgcattagaagttatctgccagggtttaaatcttagaagaaacttgacacttaacagttttgttgattattcatctctagaccagggtctttcaagaatgccttgcttggggaatttttttttttttttttttgagatggagtttcacacttgctgcccaggctggagtgcagtggcacagtctcagctcatcacaacctctgcctcccgggttcaagcaattctcctgcctcagcctcccgagtagctgggattacaggcatgcaccaccacacctggctaattttgtatttttagtagagatggggtttctccatgttggtcaggctggtctccaatttctgaccaggtgatctgcccgcctcggccccccaaagtgctgggattacaggcatcttgggaaacttttttatgtgttataggatctttggcagcatctctggcccctttccactagatgtatgctaggagcaccttcctccaagttgttacaaccaaaaatgtctccagacattgccaggtgtttgctgggtggggtgggggcaatagcctccagtggagaagtacaacttcagattgaaaatgcagagcaaaatgtcagtacagtggttggtagaatgaaaatatggcatctgtttggtgcagttgtccctagttccatccaaatgttctcagatttaagtaaatgaaatttgtgaggaattattttgtggtataataacaggttttggatatgtgatacgatttgcttttttttaactggttactgcatactaaatcttaaagcttatcagtcagccagagaaagaagctatcacaggcaacatatatttatcactacctgattgaactagcttctatctatgtatttgtgtgtcttgttggaaattatgtccatatataatttaaaattcatctgatatcaattgattaaaataataaaatgattttgatatagcctaaagggagtacaaagaaaacacactaatatgtgaaagtaagtttaaatatatcttgattataagaccatatttctgtcattcttttttaaccttagctaattttttaagaagtagcaggtttagcaatgagattcctattttgattcaatcgtttcattgcagacagtgagatttttaaagcagaggtgaaattagctgaaggcatggtattcatattaaatgcctgacactgtgttccgtataataattaagtgcagaaagtaatcaatttgtgcagaaccagtttgctaatgatgatgcactctagtccttacatagtcactatttttagattctttgtagaaaaaggagaaattacctgtctaggcccagttaccccggcaaccatttggtgcaactaagaaaacctaaagaccatattgatgatccataacgatgtcagaagagttcaggttatcagagtgacagcaagaaagatttcaaagacactcaggtctccctgggaaaataatgtctgctttcatctccaaaagagcctgtcacttgaactaaaaagggggccgaggcgcaccgccagcacactcgcagatttatttgtcgcatgtcagcttccattcaggacaagaagcttcacttttttttttctctcttctgagagatgacagtgctaatgtagcaaagaaagcagaaatggaattacaaatacatatctagtacctgctttaaaagagtgtctggctaatttcctctggaaaacaaaaacactcccattattctcactgaaatagcgatggattaaagtaaaattataaaaatttgcaatactgtgaactaggactgaggatagatacaatggagaatctgagaatatttcctatgaggctataaaatggaatttaataattataagttcaggataaaaccataatacctgaaaaatggaatgattttaaaaaagaataataaaagtttccagttctgggaatggtaaaatagcatatatcagcctaactcccaagatgataaaaacaagaaactttgggaaaagcaaaagtatatatagacatttgagagacaccaaaatcaagttggggagtgtcctcttccactgaggacacatctgaactccaaaaatggggagtgagaatacaaatgtgcaataaaaatgagacatacaaaaaacaggactctgcacccaaaggacaaaagacaaagcaaacgatagaaacaaatcatgagaggacccagatgttagaactggcaaacaaggactttacagatgctatttaaaatatgttcaataacttacaggaaaatatggactgaaagagtgaacgtatgggaaagaccaacagagaaattgaaactgtagaaaacagtctgtagaaatgaaaaaaaatcaccatatttgtttaatacaagattagagaaggaagaagaaagtatcagtgaacttgaagataaatcttagaaaattattcaatctgaagcatggagagaaagaagactgcaaagaaaatgattagagcttcagtgacaagtaggacatcatcagataacgtgacacacacatatgactagaggcccagaaaaataggagatacggaatgcagaagaaaaaagtattcagagataatgaccttagttttatcgactttggtataaaagtaaggttgcagatctaagaaactcagcaaactccaaaaataaacacaaagaaaattctatgtcagtacatcagagttaagctgctgaaaaccgaagataaagagaaaaacttaaaaatctgagggaggaaaaatattacataatgaggacatcaataacaaatggtagatgattcatcggatattttggaggacaggagacaatggagcaacatctttaaaatgttgaaaagaaaacgaaaaacaaagacacagccctgccaacgcagacttctgtagcaaaaaacccaacaacaacaggctttaaaaattaaggaaaaataaagatattttcagtaataaagaggtgaaagaatataatgtcagcagccctgcacattaataaatgataaatgaagtcatgccggatatagagaatggacatttatatctacaggatatagataacatggaacagaaatggaacataaaatggagacatatctataagaacaaataccatgagaaatggtaaatatattagtaaatatttagcaaaattgtgttttcttttttaatttctttaaacaattgatgattataacattataaaattaccacacttggccatgtgctgtcgctcacgcctgtaatcccagcattttaggaagccgagacaggcggctcactcgaggtcaggagtttgagaccagcctggccaacatggcaaaatcctgtctctgctaaaaatacaaaaactagccaggtgtggtggcatgtgcctgtaatcccagctacaggcagaggcaggagaacagcttgaacccaggaggtggaggttgcagtgagccgagatcctgctactgcactccagcctgggtgacagagtgagactccatctctaaaaataaaataaaataaaataaataaaatgaaataaaataataaaataaaaaataaaataaaatgaaataaaataataataaataaaataaagtaaaataaaataacactttattatagagtaaatataatagatgtaataacacaaagggcagaattatttgttgcagggttcttacatttcacataaagtactgcaatcttaacttttagcagagataatttaaaacatatacacacacattgatatacatatagattgtgtgtgtgtgtgtgtaaatcaattggagcttatcttataatgcaagattggaagaacattaaaaatctaatccgtgtaagtcactatgttaatagaataagggagcaaatccaattgattatctcaatatatacagaaaaaatcatttgatgaaacttgcatccattcagcataaagaatttctagcaaactgagactctagagagcttccttgacctaatgagtggcatcctgaacaatctacagctaaaatcatacttcctggttaaacactaaatgtttttcatttaagattgagaccaaatcaaggatgcccacatccaccacttccattcaacattatactagcagccctagttaggcttgagtagaaataaaatggatggagtttggaaaggaaaaatttcagctgtcttaattacaggcattgttgtttacaaagaatatgccaagaaaacaataaagcaatttctaaaagagagtttaaaaagtcattggatataagaatgatacacaaaatgcaattttatttctatatactcagaacaaacaattggaaactaatattttgaaactttcatttacaataacataaaacataagataggaatatattttaaacaaacgtgaaagatttcaacatacaaaaatacaaaactctgctaatataaaattgaaataacctaaaaaattgaaaagatataccatattcaaggattagaaaactaaatattcctaagttaacaattctctctaaaacgattaatgtgatttcaagcaaaactgaggcatggtggcttgtgcctgtaatcctagccctttgggaggctgaggcccttagcccaggagtttgaggccagcctgggaaacatggcaaaactttgtctctacaaaaaaaaaaaaaaaaaaaaaaggcgtggtgtgcacctgcagtcccagctacttgggagattgtgccacaccaaggacaacagagggagagagacactgtctcaaaaaaaaaaaaaaaatatatatatatatatatatatacacacacacacacacatatacacatactatatgtaccttttcaacaaattaacactgaaacaactcaataaatgtatggcaaaaaaatgagtattaatccctacatcacacttcatatccacacaaaattaagttgctatccgtatagaattgaatataaagtataaagcaacacagtctccaaaagaaaacagaataattcttcatgatttgcgaataggtgacgatttcttaggacacagaaagcattaaatgtcaacacaaatacattattaagaaaagaaaaaggcaaccacagactgggataaaatattttatacacacacaaatatatgtgtcatatatatgttgacagatattatatataatctctataggaatcttacaaatgtatcagatcattataagatatctgacatagatactatatatatatttccttgtatttcaattgttgtattccacaacaaatcaaaaacaaaaaggcaaacagtctaatataacaatggccaaagatttgagcagacacccactaaaggaaacacacggatggccaataggcacataaaacacgtgccttccacggtatttctgggaaaaatatacaacctgcgtttagtcatgaggaaatatgagacaaacccaatttcagcaactgactacaaaattactcttcaaaaatgtaaaagtcaagaaacacaaaagaggctgaagaatgttccagatgaaaagaggctgaaatgacatgaaacataaataatgggtgatacggactgctctggaaaaaaaacagtgacgagggatattagcggtcaatggacagaattttgctgtggacagtgagttagataatagtactgttccaaagttacatcttctaattatattctaagtgtactctgattatgatgatatatatgcacatataaagcgtgcatactctattattatgtttcttctaagctcaagcacaggcaaaaccagcacatcctaagaggaatcagagcagtgatctctgttggatgtggatttattgaaaggagcacttaaggaattttggtaatggaaatgttttatatcttgatcgtttttgtggttactctggtgtgtatatatttagcaaaactaagctgtacacttaagatctgtatatttcactgtatgtaaaatttacctacaaaaagagaagtataactgaagaacatttttctaaacacttgagttttcagagcttaatgtaaaaaccagtgaaaagaaatctacagctaaacacattttacaaaaaccatggaattataaaggacacgtgaaataactccagtactcctaagtattaatgactgatcatggacaatgaatagcaatcatgatgacatctaacttctctgtaaaattaaacacaggatgtgatgaggcaacgtctgcagtgcgttaaagacaaaagcatcaatttttcattttaatattttaaagttgtctttttcatctctgatagtaagagacaaaatgcttacaacccaaggacactgcaatatgctacttatgagcatagcctggaggaaacaaactccagggacttctccagccacctgaaacatgagctggaatgaagaagtgagattcaggaatttggaaaggagtagggggtggagggaagagctgcagcacagccccatcaccatgaagaccctacataactggcctccctgaccaagaactaggccccaaggttctgggggaatgagtggcactttcctcaaaggtgtctggtactattaaccattaactgtcacctttccctgatggaattgcaagctatcctaattttgcttgcctcctttctttttgtttataatactttccaattttcaacaaaaaagatattcaacaatggagattcattacttttataataaaatcaaaaactaaaaaaaatctactcattcttatctttcattatgggacaaccctttaattgaacacaaaaattcttttaaaaaacaaaagatgtcccctccagcaaggtctcttaccagactcagaaatcctgtggcatgtgattgcaattatgtcaaaatgacccacttatgcctagaaaaaatgtgtcacagtgttgatttgtatgcctgaggctggctgacctattggtaacttttcttctgattttcatacatttcctttaatatgcatgtatttctttttataaatggaaaaacatatataaaagaaacatgcatttgtaactattactatataagagaaaaaaccatatggatgatagaaaaataatggaatatgaaaatttgatctatgtaaacatactgaaaatttctatggagacttctctaagattaagatcctagtttgcctgcgatagttctgggtcatgcctgttctcttggcataattattagtcctttctgtttcagcctcaaaagtgtcccaggttggatgttaaattatatggccagcctacttaagatacttttagagagatttaaaacatgcttaagtaccctacttaagatatctttagaggtttttaatacacggcatttaatacaaactttatttagcttctacccattctcagagacttcatggaagtttgcatgcaattactatttgtaattaaagttattaaaagaggatttcttatgagaaaatgatgaagatgaggtcatcaatctctcagtagtttcctttattcctgtaaagaattccctagtgagaaaaccccaaataacttgaggaagtattaggttggtgcaaaagtaattgctgtttttgccattactttttgcaatcacttttgcaccaacctaacagataaagtgactgtttgtgggagtgagcgggtgtggattttccgtctgtttataactttgtgtgaggaaacaccagttttaaattaaggacttcttaggagctgtcattgtttaacctgaacatctgagttgtattaccattcctcttaagtcaatcaggaaatatagaaacagttgatgaaagcttgctaacactgtgcttacctgttttgaaaacagtgaactcttgttctgattaacgttttgctttatcaggaaaaccagacctttttggtaatgtttaacaactacgacatttaccccctagacatgaaagacatatacttggaagttgtttaattatttgtatgtgccactttcttccataatttgttttcctgcagatggaactcccaaaattatttctgcctttagtgaaaaggtggtgagtccagcagagccggtttcccttatgtgcaacgtgaagggaacacctttgcccacgatcacgtggaccctggacgatgacccgattctcaagggtggcagtcaccgcatcagccagatgatcacgtcggaggggaacgtggtcagctacctgaacatctccagctcccaggtccgggacgggggagtctaccgctgcactgccaacaactcggcgggagtcgtcctgtaccaggctcgaataaacgtaagaggtgcttgtcaaatcagctcctcaaaaaaacacacataactcattatagtggagaagaagatttctgcatgcaccgagctgggtcttggaatgccagagcggattaactgttgcttcccatttcctaccctctccttcctactcaggaatggcactgactgggttaatgttggaaatggcattttggtttctgtagtcagcttgttcttttttactctagatctgttcacctgatgtttcctttcctggtttatgctctgcatgccctttcccttctccttctcttcggttcttccacattcatggtaaaccttcatgtacatggtattaaacttacattcatgctgcaacgtgatgtaacctccattgtcgtcctagattttacagagagagttaaacaattgatcaattgctgccagtgtgttcaccaaaagtgcgtgattgtccagtatagactagttactttctattaattaaattgccttttatcttgtaatttttaattcaaaacattttcatagaagtagcagataaagtgtttcacagttatacatttgaatttaagaaaaggaaagaaaaacctttgttgtagaaaatgccacatgcaaaaatatttgtttaactgaaaaagatgtgcttacatgaatataatctacatttttaactcaaggaaaagtgtacccatttccctacatgagatgtacccttaaattattttcaagagtttctttgtgtctctccagggcctgcaagcattcgaccaatgaaaaacatcacagcaatagcaggacgggacacatacattcactgtcgtgtgattggctatccgtattactccattaaatggtacaagaactctaacctgcttcctttcaaccaccgccaagtggcatttgagaacaatggaactcttaaactttcagatgtgcaaaaggaagtggacgagggggagtacacgtgcaacgtgttggttcaaccacaactctccaccagccagagcgtccacgtgaccgtgaaaggtaagccctgttctcctggttcccacacaactcattccatagcccgactacttcccagaccaatgatttgaagtcgggtaatccaagatctgcttatttagagcaggataattgtacaggctgaagaatgacagggaacatgagatgtcctctttactactgactgaatcttcacaggaactttagttgatctgattttctctccaggtggaattttggcttggttttccagagggcatgtgttgttaacaatacaacagaaaaaaaaggagcacatcattagcttcattatctagtcatctctcagataatttttaaataaataaccttcttttcctaaaacctcctaaaagcaaggtctcttagaacttcactggaagggattttctgtattggatgaggatttcaaacaaacgtcttatcttctgtagatgagcaggtcaaagcaacaacatagaaattatatgtttaaaggatgccacagaacgttttcctcattaaattattctttgcatcatgacatggactgtcatggaatctacctgtcaggatgatctttagagatcctgcaatttgaattgactacaatctccttaccagaaaaaaacaataaggtgatcagactcatccaaggatacgcagacttttagtggcagagcctcagaaagactcatttcttctattctacaagtcagtttcctgagctgaatatgaaataaaattgttttaattatgtaaggaatctacctgaggtgggtcctaggaatagaactaatatgttataaaactatttccgaaacctgtgggtgttgcttctagccacattgagctgcctgtctgaggtgtccaagttctctctccaggaaccaataagtggcttttagttgcccttgttacaaagttgcataggtttcctgtggtcttccccaagcttcttttcccaccaaccctgtgagttttacttttgtgagaacgcatacagacacacacacatggaaataataatatgtgtatactattattacggggcatatatattgcattacattatatattatagaatatgtattgtgcattgtatattagatatgcctgcacataattataaatcggtttttaataaccatatgtcttgagaatttcctcaaatcactagatattcttggtaaaccaggctgcataaaggttcatttggtggttgtgtttatttatttaatcctcatttacagaacatctgcttcatgccaggcactactctagacactgaggaatacaacaatgaaaaaggtctgcaaggtcctttccttcattgactctcttctcagtcaggagagacaaacaataaacaaataaaacaagtgaataaaccagaaaacacctaatggtactccatactatgcagagaattaaaacatggcagtatcttaatggttcattgcaatagtcagatgccatatcaacacattttctgtactctgtcatcttaaaattcattggtctatcatacccttggaaggaatgttttacccacacatgattttgtaacataaaaagttgatcatttggaaatgattggttcactgtgttacacagatcttccaaatgttgatacaatttgttatacaatatcaaaatatcacaactactaacattaccatgatctcatcagaaagtcttcaagtaaactgtcaagttcatgctgatggatgcaagttttctaaaattctattctttcttgaaagattcaattttattatttataataaacaccatcaattgtaattgtaggagtgatgggctcatttatctgtaagaaattgtttgacaaatagaaaagaccgcataaccatcgtttttaggtagccattcttttaagaaagaaatggaattccatgaagaaaagcagctggtcgaatttgcaactcaagcaagcacagacatactctgcttgaaaatagccgtgctgctcaggaggtggaggaaacactgtgccttcttcccattttattacacaggacatagaacattaaaaataacgtgagctttagggtaaagatgtaataaaactgttatgtttcctgcttcgtcaagtgtctgtaagtgaatctggcatttttaaaaaaccaactcacagtatgcatcggtaaacagtacaatgaatagtcatcctgttagtgtccctgctgggattcatggtaacgcccagcagtctcacccaccatggcttttgctccaacagtgcaaatgtcaacaccatgagaaaggcaaacagcacctcagcattgtcatgaaaacgattttcttcttacagatcacctaaaattgtctcagggatccctacaggtctgtgagctacattttgaaaacatctaatacagtgctaaaattttagtttatttttaatgtttgaccattacaaatgaggcatcaaatgaacttctttatgcattggcctttgtctgattttaagattatttctttcgagaaaaatttccagaagtatgaccattggataaataggtataatactttaatgtaatttttaggagacatagatttaaacgaaagccctttgaatcattaacatttattctttaaatttgccagatcagtataaatgaatgtattcatcttaatccttttgaagtgacagaaaccaactcaaactagcttatggccaaaagaataatttattgtctcttataaacaatatatttatgattttaggaaataattctattgaataattttttcttcaggagcttcttttcttctgaatacttatcatatagtataaaacttgtcagctcctttgcaagtacttgcaaacaaaagaaggaaaatattattttatgtggtattttattgcctggagagaaatggcagttgttgggatttggggcttgccaaatttttcagaatagtcgggaaaagctgcctggaaaaagtgagattttgagcaaagatgtgaaggggttcaagacagctcatggatacctggggaagggacatcctaggtaaagggaagagatacaaccacggtgtctagagtttgcctggcaagcttgaggaataacagagaggctggtgtggtgggagccaagtgaacaagaaaacactaaaaggccctgagtcagaaggagcagaaccttttcacgggggacttactagatcaggacttcggttttcaggacgtggggttttctgctgagtgagatgggggctttattggatgactttaaacagaaaagtcacatggccagactaaggttttaaaaggatgcttttagccaggcaaggtgggacgagcccgtagtcccagatactccagaggctgagacaggagaatacttccagtctagtagtttgaggttgtggttgtggtgcactatatttgcacctgtgaatagacactgcactccagcctgggcaacatagtgagaccccatctctaaaaagaagaaggacgcatctgattcctgtgctgagaatggtctattcggggaaagggggcaagtagaatgacctgttggaaagtgaatccaggtgagagatgatggtggcttggaccagggggagagcagaggaggttgggggtagaagacagactccggatctatttcgaaggtctattcagtcggttttcctagtggttggatacaggtgtgaggaaaataaagacatcaaggatcaggtcaggcttctggcctgaatatcaggaagaatggcattgctttctactgagtcagcagaagatgcagtggagccgtttgaggaaggcgattaggagtctagttatcgatgtgttgaggttgaaatacacactaaacaaagaagtggatgctgtcagtaggaaattagatatgggagagtagagttcaggaatccaggctgcagatctggtgacatcagtgaatagatgatgttcaacaccaaggcctgaacaggaccctcaggggactttgtgcactacaccgcagattttaacttcatatgtacaggcttccccagcccccagtcaggctcacattagaacccttcaccaaatatctgaaaataaagtctgacaaaaattcaaacaaggactgtttgaaatgtaagtttacctatttttagatttcccagattggcacagatccatgtattgactatgaccccattggttgcaaggtgcgagaacccaaattacctttgcttaagcagccaggtgcagaggctcactgctgtaatcccagctacttgggaggcctaggtgtgatgtggtacgcacctgtagctccagctactccggagactcaggcagaagaatggcttgaggccaggagtgcaagactgtggtgaactacttccaaaacacagtaacagttttacaccattcgcaatcttagcctttactcagaacttagaagggtcttaaataaaatgacttctgaacatttaagtttacattttaaaatattttaacctcagcactttgggagaccgaggcaggaggatcacttgaggccaggagtttgagatcagcctggccaacgtggcaaaacctggtctctactaaaaatacaaaaattagccaggcatggtggcacacacctgtaatcctagatactcaggtggctgaggagggaggatggcttgaacccaggaggcggagtttgcagtgagccaagatagcaccactgcactccatcctgggtgacagggaagactctgtctcaatcaatcaatcgatcgatcagtaaaatgtttttaaatgaaatattaatatataaagtaaattatactccaatggtcaggattgtagtttatcaaggctttttaaaaattaacctttactattttcagttaccaagtattaggggagggagataagaaattagctaaattttaggaaaagacttagaattttggctttccctgtggattaggattgaaagagactttcttattttgttcatgtaaatgcagctccactacttttcctgggagaccacacagtgaatatttcagccagctaattttggaagagcaaacctgaagccttaaaaattggcttccttgggaagtggaagtggcccacttgatcccggcaataatgctgctaacagggaaaccaaattattgttatcttgtccccaggaggttcgttttaaatactggatatagcggaaagtgtgtgcatatgtgtttagatgatatttggaaacaatactattttttcatcatgtcttttcctggcaatagtcataaccctttgcttattttggagcatatgcctgcaattttttttatttcaaagattgatataaataatatgcttattattgatggtggttgaagcttaagcagttctgaaatatatgtaactatccagaagtgcaagtttgctgccttcaaacatataggcagaagtaaaagtcaaagtcccttctttcacttcatttcaacttaacaagcagttttatatttaacacattttcaagctttgtctttcccattttaggtgccacattgaacttgaacggtgcttaattgcgtgttctaattgctggggatcaacactgccaggaaagttaattggctgctggataaaaatgtcaccttttatttatatttatataaaactttatagtttacaaaacactttcatctgtgtcaccttaattaatacagtgactctgtaacgtagataaagcataatcagggaaagaatagaagagagatgaggctgcgcacagtcacccagtaatacattcaagactcaaacgcagatgttttgattccaacacaacccgtggtgactctcagaagaataattcgtattgcagcgggaagccagggtaggagtggggagaaatgaatacaaagaacccaggaataaagctatttaaaaagtcaagacagacaacatgttaaaatgtagggcaaaagatattgagggactaatttaagagagatagcatttgttaaattggagagaggaaaaggagagaatggatttggtgaaagagggcaggtcagaacaagaaaggactccagaagctcttgcttgggagatggagaggctgagaggagcgatgtggcacctgagtgtcttggcgaaagcctttggatggcggggttggtcttaagtgcctgtggatcaccattctggcttcagaccatggggatttaaaaaaatagacaggaaagcaaactaaaattcatagagaagggtagttaaaatcacaggtaaataaatgtctaagaagcaccaagctttcagagtcatattttatgaggatttttaaaagtgaatgtttgccaatagtgagatgaaatggccatgctaggaatgcagagaacaacagaaacattcgcttttacatatttcattccatttctatatttgtggcgatttctcattttaatgtaccagcatttttttaccatgtcctccttcaaattgaagggagaattagatgtcactgccagggttttcagctcttgtgttggtggtactttgtgtactgtagcccaacagggacactgttctgcacattttgacgttaaaatcctgcttccctgcagctttttgtcctgtgctgtgtctcgtctgtcaccgtaatgtcttgctgtattgctgttggtgcaagtggggaaatgaatgctgagttaaaaataatgctgtgagtgtgtctgctcgccttccactcgaggtgagcggccggggatgccgtcttctaatgacatcattcttcaaaggctgggaacaaatgtcatctcgcctaggtggagggacagctttgtgcacagaaacagccttggcagtttccccactcctgctttcagacatttgctcattagctgttccaaccttggcactatcagcttccactgaattccaaacccaactctgttggcaaggaaaggtctttcattcttaatctgtcactttcttccactttctcctactatctctctagatactggagttacttgcaatattgtttatggaaaggacagcattttgagtttatttttccattttagttcctcattaaagtggagcaatggttaacttaagctccagtttgctggggtcttttgtgtgtggccatacactgcagtcatccacatattttcatatttatttttcaacaacgacttgggaattgcagagcttctattatgaataatacacgagaaatatagacctggggaaaaatagaatggtaacgtattaaatgtataatccttttatgttaatttattatttaaaatgagaatttatactctctttttaatttaataccctaatgtgagaaaagaaagctaatgaagtgggaactttcactgtcctccctttttaaatgacgcaagaaagcactcatgcttcaatatacttaaatggatgcattggctcagctaccctgggggtttatgctctcaagtgtctgcagaagagaggtaggatatcaaaattgagtgcaggactcagcttctatgggttccttcagacaggtttgtcctggaggtggaatgacttaaaattcctctattctagaaatcgaagcagacacctttctttaaaatatggcattttattaagtgttttataagcgatatctcaaattactttaccctaattggagggaaaaaaagactatgtgtaagattggtttcattatgaaagaatgctatatatatatatatgtataatatatatttattatataatacatatataaatatatgcataatttattatatataaatatatgcatataatataataaatatataatttattatatataaatatatgcatataatataataaatatattttgatatatataaatatatgcataaatatatgttatgtattgcatatattacattacatattgattttaaatgtatatacatgattttttacattgtaaataaaataatatgtatttacattttaaataaagtgatacgtatttcctgtgtatagtataatgttttgaaatatatatccattgtggaatgactaaatctgatcaaataacatataggttgtctcacatagttatcatgtttgtggtaagaacactttacattcactgtaaacatttttcaagaatacaataaattattagctacagtcaccatgttgtacaatagatctcttggacttttcctcctgaaattttgtgtcctttgacacacacctccccagtaactccagcccttgggaaccaccattctcctttctacttctataagatcaacctttttagattgcatatatgagttagatgatgtggtatttgcctttatgtgcctggcttatttcacttaatataatgttctccaggttcatccatattgtcacaaaggactacagctcactctttcttaaggttgaatagtcttaaggctgaaggtccttattttattttttatttttattatttatttatttatttatttatttatttatttatttatttatttagagacggagtctcactctgtggccaggctggagtgcagtggcgcgatctcggctcactgcatcctctgcctcctgggttcaagtgattctcctgcctcagcctcccaagtagctgggactacaggcgtgcaccactatgcccagctaatttttgtatttttagtggagacaagccttcgccatattgaccaggatggtctcaatctcttgacctcgtgatctgcctgcctcggcctcccaaagtgcagggattacagttgttttattttaacttgtccctttttttggcaaccattgtgtatgtataccatatattttttaatccattcatctgctggtgaccatttagccacttgaatccatatcttggctattgtaaacaatgccacaatgaacatggaagtgtagatatctcttcaacacactgatttcatatccttttcatgtatacccagtaatgggattgctagaaaatatggtggttctatttttaatgttttgaggaacctccatactattttctatagtgagtataataacttgcattcctatcaatacagtacaaagcttctcttttctccacatgttcaccgatgcttgtttttttcatgttttttataatagccattctaacatgtgtgagatgataacctcattttggttttagtttgcatttccctgataattagcgatgttgagcattttttatatacctgttagccatgtatgtcttcttttgagaaatgtttattcaggttcattgcccattttttaatattcattcaatttgcctattttcaaatcaggttgttttcttgctattgcattgtttgaatcctttatatattttggatagtaaccttttatcagatgtacggtttgcaaatatattctttccttctatatataggttgtcacttcattcactctggtgattgattcctttgctgtgcagaagtttttttagtttgatgtaatcccattgttctatttttgcgtttgttgtccatgcttttggggtaataaccaaaagtcactgcccagagcaatgttaggagatttttccctatgttttctcctagtagtgtcatagtttaggcccttccatttaagtcttaaatccagtttgagtttaattgtgtatatggcattagagacatcataaattaaagttaatgatctaattccatttttctgcttgtgggtatctagtttccccaacaccatttactgaaaagaccccattgtgtgctcttggctcctttgttaaaaatcagtttgctgtaaatgtgtggatttaccattctggtccattggtctatgattttatggaagtacaatgctgtttggttattatagctcagtagtatattttgaagtcatgtggtgtgatgcctctagctttgttctttttcctcaagattgttttggctattctggctcttttttggttatattggaattttaggatttttttttctatttctgtgaaaaatgtcattggtattttggtagaaagtacattgactctgtaggtcacttcaggtaagatgggcattttaacaacatgaattcttctcatccatgaacacaagttatgtttccatttatttctgtctttctcaacttctttcaccaatgttttatacttatcactgtagagatctttcacctccttggttaatttattcataagtattttagtttttgtagctattgtaaatgagattgttttctttaatttttttcagatagttcactattagtgtatacaaacactactgatttttgccttgtagctttatcatatgattatttcaataggtgtagaaaaatacttgacaaaatttaacatcctttcatgataaatattctcaacaatttagatacagaaggaatgttcctcaacataataaaggccatacatgacaaacctacagctaacattgtactcgagacaagttggaagcttttccttaagattctgaacaaaaaaaaaaagatgcacactcttgccacttccattcaacatgtcactggaagtctcagccaaagcaattaggcaagagaaagaaatacaaggcattcagataattcaaattggaaaggaagaaattaacttgtttgcaaatgacatgaccatatatatagaaaaccctaagacactaccaaaaaggattagaagtaataaaccaattcagtaaagttgcaggatacaaaatcaacatataagaatacaattcttttatttagttaaaattgcaagataaattatgttttataatacttgttgcacttgctgaacatgggaaacttagagaaggagagaattatgtagagataagaaagggaaaagaatgccaagcaaattactaacacttttgctgtctaattcataattaatctgcaaatacacacacgtttgtgcacacaccacagggaaaaactctttggcagtgctaaaaataatgccgtgataatgacattttaagtcagaaataacaactctcaattattcagaaccatgcggtaggatcttttatatgcattgactcaaaacacatgtaaattgtttaaatatataaattcaataaaattgtgtacttcatacacctatataacatttatatgcattatattttaaatataaagatatataaatataaaacacaaatataaatatacatatagttatatatgtatattatatataagtacatatatatgtggttacagatatatagatgcatgatacaattatagactcttagaatcttagggctataaatcagcttgaagttcatctagaccagcctcccatgtgatattcaacatgcccctggactgtaccccacatttttctagactcttcctgcacgatctgtgcagtggttcactaagctctcagccctttctgtttctacatggctgtgattgtcagacagttcttcctctgtctgacatacatacaaatagagatacatacaaatatgccttctctagctcttctcttctttctggttcgaatattccctctagagcaacactaaatagttccccgtttctccacataaagctcccagtcgtgcaaaagactaagctttgtcttcctggctaaccatctctagcgtccccatttgtttaaatactttgtatgcaacgaagttcagcagctcctttcctttgaaggacacactgatgtgtctattttgtctcaatgaaacatagccctctgggcattttctaatgaataaaagaggggaatgagagtgccacctctgtcctgaagacaagaacgcctagttgcagcccatgtcccactgttgagccatggtttgggactcatgaacaaaaatcccaatggtgaattttgtttttgttttgtcaacttttggctgacaccacaccattatcatctgtccatgcaagatccttattttgttttattttaacttgtccccccttttttcaaccatccaccaattctggtatcgtttgtccctgtctcataggcacagacttatgtgtacttaatatatttattttaaattaattttctggcatccttatttagacatgcatgtaaatatatacaataacagcacaaaagtgaatgcttagtttgccccccacccagccctttgactctgtacaaatactaccatgggtatcttataaatgtgtccatgtgtagtattaatattactagagggccagtagtagaattgttaggtcatagaatttaacttcactaataattgcatagccactctccaaaattcctataccagtttactttaccaccagctatgcattagaggtcccagttccccgcatcctggtacctgtgtttctatttgtgacaaagctgattgatgtaaaggagctctttgttttaatttgttttcttttcattactattgtgcttgaatgtctttttatactctcaggagatgtctgaggatttcatctatgcattgctttgtgcatttgctatcactcctgctacttcttcctgctttgctgtagttctttagtataaatatgaatctcttattacttagaaatgattgtgaatatcttttccaaggctgtcttttctctcttaactttgcctttgtcttcatttggaccttgtttaagaaatttatgagctcatgaagatgcattcctatttttttctgtatttgttctatgtctctatttttgctgtttgcatttaggccttcaacccacactgagcttcacagatatagtaaagctggggtccaatatattttctatctatatcgagtcagttatcccaatatttattaaatgacccatgttttcttctcctctccatctaccaagataccatgatggtgctgtcagaggcagtcttagttctgtgaaatatattgactacctttttatacccttgtctcactgtaacatatttcagcactttacttaaaaaaaagcctcttcaagtcagttattattaaccaagcttctaaagagctatgaccttttctaagccaacgtcatgaaaaatacttctcaagcaaataatctattactaacaatccttgtaaaaaaactaattggaaaaataagccaagttttaaaatgaataccagtgattttatgaatcttgtttacttttgttattaagcctggttgtcgtcacctctggttggggtcacatggctttgcttccatcagaagtccatataaacaaaaataaaataattgtacctcatctagatgacacttttctctaactaaataagtaaaacatgagatatgtttcattttcttgatgccttgatgattcaaatggcttttcttttcatattaaaaatgcagaaaagtaactcagttttattacagtcttctgtatgaaggtattattgctctcaaccaggggaaacataacctgtcatcctgctcagaccatggtgactctaattgtttacatatagatattatcataagtttttaagttcttggtcgttttaatcttttaaagaaactatttcaacataatatgattatggctttacaatacactccataaaaataactttcaagagatgtttcatatgattgaagactcaaatggccccaagaaattatccagttctttccaccacattcccctttaggcatctggttgacaatattgcagggcatccattttttttggaagtgcattggaaggagacactgccatgcttctcagagtttgttttactcttttacgcccccaaatttcaagtagtttattttttccctttattgtatccaacttgcatcttttgtgtttctctttattataattctactttatgccttgggatatctttttcttgttcctaaaacattttaattatttttttcctcccatggacttacttgataattttaaacaatttttgggaaaaaagttatttgccttccttttatttccttttctctctctctcttttttttttcttttttttttttttttttttttttttttgagacagagtttcactcttgttgcccaggctggagtgtaatggcacaatatcggctcactgcaatctctgcttcctgggttcaagcaattctctacctcagcctcccaagtaactgggattacaggggtgagccaccatgcccagctaatttttgtatttttagcagagatggggtttcactatgttggccaggctggcctcaaactcctgacctcagatgatccgcccacctcagcctcccaaagtgctgggattacaggcgtgagccactgcacccagcccccttacttcgttgttatatttatgactctttacctcttttcacagtctagcagtctaaaataagcatcctatagaagaactactttgtttaaaatcattgtagaaaagttagctactcttattcctgatatattccaattattagagagaaaaactgaatttttgctcagaacactagctaaacttgggccagctgaatgagcaaaaacaacaaaacaaacacagcattttttttaagttagtgagcaacaattttaaaattcaccttttaaacgttttcccttgcttctttttttattcttcttctatcttttccttgttctgagggaaaataacaagatacttttcatcatgtatagaggggtatatttgaaagagaactcagcactaattctcttctagtcccagtcccagatgagttaaagtaatgtgaatggatggttgaagtatatggagagtgtgtcacacacagacctggttttgttattaatggtgcatgcatttttgctgtagatgaaacaaaccattgtggttgggtttttcgggaagctgactctgagatggatgctagtgtgaagagtgtttatcaaggagtgccttatgatcaacaaccgaggagggaaggacaggaagaaggactgggcgaagaaagagtgagctgggatgcaggccaatgacagtgagctctggagcaagaacagtccttcagggttgtcctgagtttgggcagaattgctcctcaatcagtcactagattgaggacactccaaaaaagagcctgtccttgggtgaagtgggcctctgcagctgagacaatctccgaggtggccaataacttccagatgacatcaccccatgaattggtggtaacatgtcctttcttgaaaggaatctggtcagtgcaactcctcccacttacgtagatgtcaaatggctatacatgtgggtcttaaacaccttttcctaaacacattttttcattcatttgcgcccactggccgggcgtggtggctcacgcctgtaatcccagcactttgggaggccgaggcgggtaaatcaactgaggtcaggagtttgagaccagcctggctaacatggtgaaaccctgtctctaccaaaaatacaaaaattagccaggtgtaatggcgggcacctgtagtaccagctactcgggagtctgaggcaggagaattgattgaacctgggaggcggaggttgccatgagccgagatcatgccactgcactccagcctgggcaacaagatgggaaacaagaatctgtctccaaaaaaaaaaaaattgctcccgctttctataatgacatgagtccaatatttcaaattagaaatgagaaatattacagtgtaccatagtgtattgtgttgtagttcatagctcaattggacctttgtcatcagaacaagtttcaactcaaaaaatctctttagttttgtgagtgctaagatgttttttaaaaatgtattcaggtaatacttgtgcgtctgctgttaatgagatcaagtaataataggatggtcactgccagcaaggtgttggggtctgtgggagaacccacagacaaatgatggcaacacacgacaggaagcagcaaatgtcctgggcgaggggcagcagaaggtccaaaacagcagccatgacacctggcgcaggagaacagcagggagacaaagaagacaaatgcagacatcaacacaataccatcagagaaatatgcagtatgtgttttaggagcagaggaagtggacatttatctaattctgggcatagggtaggctgagaagtcttgaggagccaaaaaagaatgtccaagaaaagctgagttgaatctcaaaagggtctagcgcctgaaacggtttccaaaagcagaaacaattgagtgtagttttgccattataagatgatcagagtgagaatggggctcggacagggtgtggggacagaggtgggtcaggtgcagttgctcacatgtaagagcccctatggctgacacaaaggatactcccagtaagcgaaggtctgcatctgcacagagaggaccaggcctcggagagttagcacatcctgctgaatcctaaaggtgttggagcagaggtaaatgctcgcagcaatgttttagaaacattaatctggttgaggtgggtaaggtatatcacagtgcagaaagatgaaaaaaaaaaaaaaaagaatgaccagttaggacacaattgaaagagttgtaattaaaaaggtgatagtactgtgtttggaaaaagagaaaccacacaaaagacatgttgagaattggagtagacaatacatagcagcacactctcagcagctggacacaaaaagaaatgcacaactaggaacgcttttattattcgaagcttcttgcaaccaaaatattttgctatcactactaagaacagagaattgaagaagcttagattaaggggaaacttgctatgtttggtttgggatttgagatacttctgagacatcaagatgaagatattgacatactactgaacaagcaggcatgaatcttgagaaggagtttttgtttgaaaatttagattaggagtcaacagcattgagctgacagctggggcaaaggaggtgctgagaccatcagggagagagaaggaagaacaaggccaggtcaggacactgaggaacaatggttccattagcgtatgattagtaagagacattcctttccatctgaattgttgaactatttattcatggttttcaatctcataattcaattttgtaatgtgtagtatgattcttcaaatgaatgtgatatccaccctcattaacttttgccatgggatctatgaactctcataaactcttgtagggtacttatctatcttttagacatttaaagtaaatacacataaatgaacagagatggtgactgatagggtttggctgtgtctccacccaaatctcatcttgaattttactcccataattcccacgtgttgtgggagggatctggtgggagataattgaatcatgggggcagtttcctcatactgttctcgtggtagtgaataagtcttatgagatctgatggttttatcagggatttccgcttttgcgtcttcctcattctctttgcctgatgccatccatgtaaggtgggacttgcttctccttgctttctgccatgattgtgaggctcccccagccacgtggacctgtaagtccaattaaactctttcttttgtaaattgcccagtcttggatatgtctttatccacagcatgaaaatggactaacacagtgacaaaatttattattttaaagaatatattactggcccatttaattaacttagaaataatttcaaatcatatttactataaaaaaattgtgtgatacaattctaataatggaacaaagctaacactgcaatggccatattagaatctttattgtgtaaaataaagaataattctatataggaaaaacaatatgcattatgaaataataccaggaaataaaataattcaatccactgtttaaaattacaatataatatgaggaaagatttttatcacatcagtaactatagcggacataatgttcttctattttatttcatttaattttaagttccaaggtacatgtgcaggatgtacaagtttgtcacataggtaaatgtgtgccatggtggtatgctgcacctctcaacccatcacctaggtattaagcccagcatgcattagctatttttcctgatgctttccctccccttacccatgctttcacatgctttcttcctctccctgtgtccatgagttctcattgttcaactcccgcttataagtgagaacatgcagtgtttggttttctgttcctgcattagtttgtggaagataatggcttccagctccatccatgtccctgcaaaggacatgatctcattcctttctatggctgcaaagtattccatggggtatttttaccacctttaatctcttggtgcccactctgagtgagaattgtgaaatttggcctgcatgatttagttgttagtatggctgtggtcaaaaagtcaaaagataacaagtgttggcaaggctgtgtggagaaaatggaaccccgtacagtgttggtggggatgtaaattagtgtagacatgataggaaacaataggaagtttcctaaaaaaatttatataatccagtaattccactactgggtgtatatccagaggaaatgaaatcactctgtgaagggggtacctgtgatcccacgttcatggcagcactatccacgacagccaagacatggaaacaacttaagtgtccattggtagatgaatggataaagagaatgtcacacacacatacacacacacacacatgcacacacgaacattatttagcctttcttgtttgttttctccaagtcacagcaggttcagtgccttgacactttctgaaactaaggaagacatggatgattgggtccagctatttttttctgtccatggggaacatgttttcttagaatggagaatgtggccagagaaaactttggtctgctgtttttacttataactcctcccctaaaggaggtatacttctcatttgagtacaccttaaataattcaaaagatgtaaatttatcaaaatatactcaaaactcctacttcattcatccacagaaattcaaatgtggtatttcaaatctatgtctagagaaaaacagatacttgaaacattttttaaagttttgtatgatttgggctattacaaatatgcccaagacacagttctttaaggaaaccttaaagatagatcctaaaagtcatctccaccacactgcaaggacaatgccttgtccttccctgtccttcccacccagaaggcagggccaaagaattccccactggctcactcttgcctttttcgcctaggtcaatgtcagttaatatcagctcatattgaaccccgcggggagcttggagtgagaggctaagaagggaaactaatggaatctaagttgatgtgacccacgcagcctctggtttcttttagcacccaccggctccagcaatatccttatcactccctcatcatatgtctctgcatcttggcctcctgcccttcctgctaaagcaggtgcaggtcacgggaccagcagcctaagtcacggtaagctaggtgcatctctggctgctgctggttggaagtcaccgatctcagggaaacaaactcacatagcaattcagagttggcgcgaggaccgtacctaaataaacaaggccagatattgactcaagctccccaactggccctgccagcagaggggagagttggcacagtagttagaagtcctcggcccctaggctaataagactatgaagaggagcttcactcttgtccctgccatgtcgtcattattaagtcctggaagtgtctgcctgctcctcttttctaagtcattcttttttttttttttaattatactttaagttttagggtacatgtgcacaatgtacacgttagttacacatgtatacatgtgccatgctggtgtgctgcacccattaacttgtcatttagcattaggtatatctcctaatgctatccgtcccccctccccccaccccacaacagtacccagaatgtgatgttccccttgctgtgtccatgtgttctcattgttcaattcccatctatgagtgagaacatgcggtgtttggttttttgtccttgcgacaatgatagactggattaagaaaatgtggcacatatacaccatggaatactatacagccataaaaaatgatgagttcatgtcctttgtagggacatggatgaaattggaaatcatcattctcagtaaactaagtcattcttaatgacttcaggattgtctaaagtgcagagtgtaaacatatgttcatcatcacctctgaaagtttttttctaaaaaacattattcaatcaaaatgaacaagacatccaggctcggtggctcacgcctataatcccagcactttgggaggccaaggcaggtggatcacatgaggtcaggagttcgagaccagcctggccaacatggtgaaaccccgtctctactaaaaatacaaaaaaaattagccaagcctagtggcgtgtgcctgtaatcccagctacttgggaggctgaggcaggagaatcacttgagcccgggaggtggaggttgcagtgaggcgagatcatgccactgaactccagcctaggcaacaagagtgaaaactccgtttaaaaaagaaaaagaaagaaaagaaaaaaaaagaacaggacactatttatcccactagttgtgggaaataaaaaagataaacttgatagatctcctgccctcctgggtcactctacttaagaaaatgggcacgtccataaatcactgtactcacttgagtcatcaatgtgataaattccatacaagagttttgaacaagagtgagtagaggaaccgcttacttgtgttgtatgtacattgtggagaactgtatcagactgggtcagtaatctaaaatttagctaaacgatgttgttaagtagcagaattgaccagataaccagacttatgggtgaggagatcttgaaggtataccccggactagaaactcccacctgctcacagcctcatcatttcggagtcacgccttgcactgaactggacagtaaatagccctgtggctgcgcagaagagctacttgctgtctatttcaatgcaagctgataatgaactgtgtttcattatcacctcgttacacatgaagagatagaatcgcagagctaaataaactggatcaagataacactgctaatcacccagaattgacgagcaccccacccatgattttatcaaagtcttatacgcctcttctctaggagaaatcaaagcatttccctccatgaagaagaatatacaattaatttttaagagacaagacagaaatatatcagtctgatctaatattcttgttaagggtttagatagagtaagagtcaaaattgacatttggcagtattcaatggctctgagctgcctaggaaaaggacccccgccattatgtagagtgaaatacacaagcctggtaataaatgacctttatcagatatttacgtacttcttgtagaaagggtatgtcaaaagcggtgtgtgtcatattcaggatttctgctcctatgatatacaagcttttactgtcagcaagattcagataatttaccttatttaggtgatatcatgaatcaggtaatcagtgtgtctcaaataggaggttcagctttcccaaaatcatgagaagagttttctaatcactggagttactttgtgccatcgatcttatgtcttatgaatataaaatataaggcttaagacgctttaaaaattttatgcatttgtatgcagcagacttgcaactcacagctgatgcaagcaaggcaacttaagcagtgaagaaagaattgacatgattgacaaataggtcttgtgatttaatttacattaacaatgatgtaatgtgcatactgacctaatgtgtccttacataatgtggcaagcaaagcaacacatagcaaacctaattttgacattcttctgggaaaacgcttttccttatgactaaacttttctttaatatttattttaaccattttggaaaggcttttttttggtagatatgttttaaaatattttaaatgtatctttttatttaatatgttaaccgtgacttataattcagaatgctaattaagtattacgattttgtattaattacaaaaatgctgactactaagggcaatgtgctcccaaacaaaatgtcatccaactactgtgtgtgttgcgtttttgtgtctgttctttataatttacttttagtttctcaccctcctccttttgcttgccaattgtggcttcttactaagccctcttcaatatgcctgaactcccagaatctgatttaggccaagatatcagataactgacagtgttgtaatgatttaaaataagatgttcaaagcaagggattatccttggagtgatgtgtatgagatttagtgcattagctttctgacactggtttttcagtgctttggaagtgtacttcttgattttcagccctgttgctttgtactaaagtaatgataaaaatattccttaaataccatacactgatgaattgcaaatattttggaattatagaaaacacagggttttggttttcgttttggttttaatgctgattcttctatagctacctcttacttctgttcttgaaaatttgtatgtgcatatatttcctgtattctataactctcttatgctctaaagggacattctaatactttacaattatttacaacctacactctatgttttccttttttttttttgagacggagtttcgctctgtctcccatgctggagtgcagtgacatgaccttggctcactgcaacctcagcctcccgggttcaagcaattctcctgcctcagcctccctagtagctgggactataggtgcacgccaccatgcctggctaattttttttttttatttttagtagaaacaaggtttttccatgttggccaggctgctcacgaactcctgacctctggtgatttgcccacctgggcctcccaaagtgttgggattacaggcgtgagccaccacacccggccttcttattaaatagctagattaaaaaatatgctatgtcttacctttctttcttgatttggagaaagtaaatcctcacgtattccttctccctgttgtaactgatagagaaaattagcccagtaacctttcaacttacctgttttttcctcatcttaaaggcttgtgaaatagaacaaatgctaagaaactgattcagatacacaactaagtttgagaattactgtgttaactcattcagagctcaaggcagcactctattttataaataaggaaactgagaccctgagaggggttaagtaactgtagtaagtagcatagctgaacttaaaccaaagtagcctggctccaaagttcttatcttagaaaaattgtctgtaattcagacagtaagcaccaagccaaggtttgtctgagtatgctgacaaccaggtttttgtgtccaggaaatcaaaggggaggaaatgtaattattttctttaataaagcatagcaatttagtattaataatatttacatatatagtgagcatttatgccacttgggggcaagagatttaaagaaatacaagcacctttggtacaacatgacattttctccagcacattccaactgagaacgttcatacctcagtctgacccgattctctccaccagcactggatagaatctcatcctgagacctttatctcttagcatcagatcagcccttttcaatcccaaagatctaactttacatggagaatccacaggaggattgacattgagtatgcttgtcggtacctttgaccatttaaaaaaattaatttccctggtaaaacctaacttgagctacctacttcttcgacctctggctgtacttgcaattttgagttctagctcccaactgcttttgaaagcagacagccgtcatagtgataatacgaaataagagaagcgccatggctgcacttccttgctgtctgcggcctatggctatatatggaagctccactggcagaggctgatgggttatgctcattgctgtgtgcccagcacgttcactgctgccacacacatcccaggtgctcaataaacatgacttgattgaatgaacaaataaatgaatgaatggttttctattcaaatttctcagccggatcccttacctcttccttaagctgatagttgaaatggacttacaattgttgaataaactgtagaaatctttaataacttcattaggaaaaactcgtaatataataattggtttatattagattatcacatgattaatcatcttagtttgtactcttagtcatttccaagcccctgcatacaaataaacctttttctttccaagaatgtatgcaaaaacacaaaaaaggcttacattacaggctctgatattagttatattgacatgatttaagccctccgagaatagttaactagttctaagaccaaaagggcaaggtaacatctttgagtatcacttttcccatctgcaaagtaaagcaataaataactaatccgtaaggctgatgaaagagcatattactttgctcataactaacaagtaacagttagagttcaaatgtggttcatctgactccattttaactatttcagaatgttaataccctatgacatcatctaggagggcactgaggaagagagttcctaaggcaaggtggacaaaacaggcatcactcagcaaagctgaatcaggaaagagctttccaggctgagtttgcttgcagtgtccatggcaggccaggctgaaggctataacccgacctccttagcaatacatcagcaagtcaaataacctgccacggaccagttcacaattaaaagttacacacgtaaagtgtgcaaaactaagagatgcaaagtaaagatgtagttattctaatatgaaataagaatttataattaatggttgttattagttggacataacagagaactttaacaataaaattggaatatttattttacttttttttttttttttagttttttagacacaggctggagtcacccaggctggagtgcactggtgccctcgtagcttactgcagcctcgaactcctgggctcaagggatcctcccgccttggcctcctcagtagctgggaccagaggtgcacaccatcgcacctggctaattttttaaaaaaatgttgtagatatgggggtcccgttatgttgcccaggctagtcttgaactcctggcctcaagtgttcctcctgccttggcctcccaaagtgctgggattacaggtgtgagccaccacatccagccaaaattggaatttctgcttcttcagtgggtttagaatatgcctatttacaaggcaggaaacaattagaaggggaacagtaattgtagtgtcatagtcgcaaagtaggaaagaaacctcctcttgtatacatcattttaaaaggctttgaaggaaaaccaaacctaaatccctctttcacactatttacactacagatatagtctgaaatgttttcattcaaaaataatttttaaattaaagtttgttgaacaaaattaacttgctgaagtacaaattgaaccatggtttttatttaaaatgatgagaacattcaaataatagaagcagaatttcaaatttgctacagttcctgtatttctatgctgtatctatgatcgtctgtactaccctttcagtgccgtatacagggttaaaggaaaagcaaatgtagaataagcacagttcgttattatctttcttttttcttgcagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagaggtgagcaaaggatcatgagccatgtggcatctgtagagttgatttaacaatggtttaagatgatggggcttgaaatatttcgaaaataactggaacttagaaattcagttttatctcactaaaaaaaaaaaaaaaaaaaaaaaaaaatacgactctaaacccaaccatgaattcccctaaactccaagataaggttttatttacctaaaatatgttttaaataattaatagctaagaaggtgggaaccataggatttaattcatgaaataaggcttccgtatgctaagccaatgagttttgaggactaacgtccgtgagcttttgctttattgtattcatataatatttttagtatttcttatttcaataaatggttttttaaaaaatatgtctcaaagctatgtatcaaagtttttctaaagagccatgaaatagcttttcataatgtttgttttagttttagaaatgtggttttctttgcccatctattctatttagcattaaatctatcattattttgggacgccattgcaacgttttaaaattaagcagagtatggtagtacttattcaaaaaaattaaaatagggtaggctaacttgtagaaaactggcagtaatctcattacatctaaactgtaagcttcagtcttattttgaacttctattcaagtcaccaaattcccattaaggctcacactcttcatctatgaaataagctgctagtgttctctaatgtatatcaaacacagacattctgtgatgtttatgattctccaagagtactatacattaatctaccattacaatattcatccacattgcaaaagtaactgtctgaagttaaagatttatattaacaatgattatttgcattttaaaattccccagattgtggtcccagagtggttgttaggagggggaggatttctgtaatttcccagagagtggagatagctctttcttgagcaggagattctcatgtccttcttcattccttactccttgtccccttgatacctcttcttccttgccagctgggaagaaatgcactttttatctacctgccagcaaaaggaagtgacacagacttagaagtcataggaagaaactaactttgtatttctgaaaaaaaaaatttccaggtgaataatttagaaaatatatattcaattagacacaaacttagcagcctcatgacatttttctcatttccaccttgcactttggagtggaagaattgggatacttgattttttcccaaattttgaaagataaataaaaaagggagccaacctagtatctgtttcccaagcgttttcttataagcagagttaactcttgggtttgtgaagggcaaaatagtacatcagcctgctttctatataatctgctctgaaggatccaggccaggaatctgaaacgtcagataaaaatgtacggggatgctttttgtacaacttgcccttgcagaaaaggcaaccagaagtttttaaccaaggcaaaatcagatgagctgaaaatgagcctagctatttgggataatgtagctgatcatgatatgactgatgtctccatgtgattgttcttcaaatatgttaaataagctttagttaaattaatattaaatcaccagtgagataatgcagcctagaggaagaaaatgtgcttcacaaacaggtcagtgtgactggagaaacaggcagggacaaggtgatgtgggactgtggttctcaatccagacagttctgtagaatctcctgggaggcttaagaaaacactgatgtgcattttttggtcccaatctacaccaattaaatcataatctttaggggtaaatccatcttccagatctctggggaattgttcttttttcccaaaaatcactagttagtggttctcaaactttgttgtacattcagattgcatagggaggtctaaaaaggtcctgatgaccaggatgaagctcctgtcaattaaataaccatctttggaggtgggacccaggcatcaataatttgtaaaatccacaggtttattctaatatgtagccaagtctcagttccagccccctgagtaattagaacgtgcagccattttgaggtgtggattttcttctagattaaagagttggcactgttgactttaaccaccacagcactatggcctgattgatctttttagttgtcacactagtagctgtctgaagaatggactgggctagaaagcaagaagagtagttaacaggctatttcagacattcagacaagataaaaatgccttggatgaaggtgttaatgttaaggtcatgagaagcagtggaattcacaatctattttggcggtaaagcaaataaaacacgcttatggagtgaatgttgcaaatgagataaagaagaacctttagtggaatcatgctttgcctaataacaaggtgaatgaaagtgtctttagcagaagcagagaagaaatgaggaagaacggtattgacaaggggaataatggtcaatgatatgggagaagcacctgtcccagcagtcactagggcactccagcatttaaggccccagaataagagaaggaggaatcagcagaagagacgaagagggaaaaggagcagcctgtaaaggaggagaaaatccagtggactgtggcactctagaagcaaaatcagaaataaatcgagaaagagaatattaaacagtattgaatcctgctgaaagtagacaaagaggaaaaccaagagttggtcactggtttaggaagatggatattgtttatgaccttgatggatattgtttatgacctggtgtcattgcagcgagggcttgattagaggagcttcagaaaagaaagaaggtcaatgtgcaggaactcagaaaacacaactatttttatatttttaggaattttgctatcacaggaggcagtaaaatggagacaaagttggaaatggacatggggcaagggcaggagttatttttaagactggatactttacagcctgctttatgcttatgagaataagccagtagagaggaaaaaaatatgtgtcaagataaagaggagattattacaggatcaaagtccttgagttagtgaatgcaaccagaattctttgtaccagtgcagtagtacgttcaaagtagtataataacaaccatggtgtgaagctccagtaggtagcaccaacagaaatgattgaaaattatagggaagggggatgttttgggtcaaagaagtggaaaaacaaaaattatctaataggaccatcacagagtaacaggtaacacatttatcctcctactacaaaccaactataaaattggtctaatatatataagaactgctttcaggaacaaaacaaagtgcatgaagtcagttccaaattcaccccagatagctgcttggggtactttctgcacatgacagagagtgcagagcccaaatagatcacagtgatcttggcaggtggagaaaacagagagagaaattgaaagatactaagatgattactgggtattgaaggacaagctactggagattagggagctattcaaagaaaggtctctagaaatctgtacagggctcctttgcagtttcagctgaatactgttcttcacatgcacagggtgctagcagaagttgcacattgcttgggaatgctggagttctaactagccagaataggggaattcagccgcaatctcaggaatgccacaccctaggagtaggactaatctatccccagcataagggttactctagaccagccctaaaagagcctaagaagattcttggcaagataaaacttctccactagtaagttaattgtgtgcataaacaatatttgacactaaaaaggaagacaacaaaatccagacccccaacagcatagcgtatccacaatgtactgcattcaataaacacaggcacacctgattttatcacacttttcttttttgttgttgttgttgtgtttttttattttattttattattattctttaagttttagggtatatgtgcacaatgtgcaggttagttacatatgtatacatgtgccatgctggtgtgctgcacccatcaactcgtcatctagcattaggtatatctcctaatgctatccctcccccctcccctcatcccacaacagtccccagagtgtgatgttccccttcctgtgtccatgtgttctcattgttcaattcccacccatgagtaagaatatgcagtgtttggttttttgttcttgtgatagtttactgggaatgatgatttccaatttcatccatgtccctacaaaggacatgaactcatcattttttatggctgcatagtattccatgatgtatatgtgccacattttcttaatccagtctatcactgttggacatttgggttggtcccaagtctttgctattgtgaatagtgcctcaataaacatacgtgtgcatgtgtctttatagcagcatgatttatagtcctttgggtatatacccagtaatgggatggctgggtcaaatggtatttctagttctagatccctgaggaatcgccacactgactttcacaatggtagaactagtttacagtcccaccaacagtgtaaaagtgttcctatttctccacatcctctccagcacctgttgtttcctgactttttaacgattgccattctaactggtgtgagatggtatctcactgtggttttgatttgcatttctctgatggccagtgacggtgagcattttttcatgtgttttttggctgcataaatgtcttcttttgagaagtgtctgttcatgtcctttgcctactttttgatggggttgttttttttttcttgtaaatttgtttgagttcattgtagattctggatattagccctttgtcagatgagtaggttgcgaaaattttctcccattttgtaggttgcctgttcactctgatagtagtttcttttgctgtgcagaagctctttagtttaattagatccaaaaagaatccaggaccagatggattcacagccaaattctaccagaggtacaaggaggaactggtaccattccttctgaaattattccaatcaatagaaaaagagggaatcctccctaactcattttatgaggccagcgtcatcctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggcttgttcaatatacgcaaattaataaatataatctagcatataacagaaccaaagacaaaaaacacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtccaattgtccctgtttgcagatgacatgattgtatatctagaaaaccccatcgtctcagcccaaaatcttcttaagctgataagcaacttcagcaaagtctcaggatacaaaatcaatgtacaaaaatcacaagcattcttatataccaataacagacaaacagagagccaaattatgagtgaactcccattcacaattgcttcaaagagaataaaatacctaggaatccaacttacaagggatgtgaaggacctcttcaaggagaactacaaaccgctgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatgtggcacaaaaaaagagcccgcgtcgccaagtcaatcctaagccaaaagaacaaagctggaggcatcatgctacctgacttcaaactatactacaaggctacagtaaccaaaacagcatggcactggtaccaaaacagagatatagaccaatggaacagaacagagccctcagaaataacgccacatatctacaactgtctgatctttgacaaacctgagaaaaacaagcaatggggaaaggattccctatttaataaatggtgctgggaaaactggctagccatatgtagaaagctgaaactggatcccttccttacaccttatacaaaaaattaattcaagatggattaaagacttaaaccttagacctaaaaccataaaaaccctagaagaaaacctaggcattaccatttaggacataggcatgggcaaggatttcatgtctaaaacaccaaaagcaatggaaacaaaagccagaattgacaaatgggatctaattaaactaaagagcttctgcacttttcttttcttcctttttttttttttttttttgagacgggatcttgctctgtcacccaggctgcagtacaatgggccaatctccactcactgcaacctctaccttccgggttcacaccattctcctgcctcagcttcctgagtagcttggattacaggcatgtgccaacatgccaagctaatttttttatttttagtagagacaaggtttcaccacgttggccaggctggtctcgaactcctggcctcaggtgatgcaccccacttggcctcccaaagtgccgagattacaggagtgagccaccatgcccggccacactttgctttattgtgcttcccagatatcgcattttttacaagttgaaggtttgtggcaatcctgcatcgagcaagtctatggggaccattttttccaacagtgtgtgcccacttcgtgtctgtatgtcacattttggtaattcttgcaacatttgaaactttatcattattattatgtctgttatggtgattggtaatcagtaatctctggtgttactattataatgttactattataattgttcagtagccatatgagatggcaaacttaatcgataaatgttgtgtgtgttctgaccactctactaaccaaccatttcccagtctccatttctcagcttccctatttcctaagacaacaatattgaccatttctcagcttccctacttcctaagacataacaatattgaaattaggccaatgaatggccccacaacagtctccggtgtttcagtgagaggaggaatcattcattgcacatctctcactttaaatcaaaagctagaaatgattgcattcagtgaggaaggcatttgaaagccaagagaggccggaagctgggcttcctatgccaaactgtttgccacattgtaaacacaaaggaaaagttcttgagggcaatgaaaaatgctactccagtgaacacacaaatggtaaagtgaaacaacctcgttgctaatatggagaacgtttaaatagtatggatagagaaaaccaaaccagccaccacattcccttaagtacaagcttgatacagggcaaggccctaactctcttctatgaaggctgagtgacgtgaggaagctgcataagaaaagtttgacctggggtcattgtaaagcttagcacattgtttgatagcctgggttagtgggaagatttgtaaagacttgatctaaaataaattagctgttgtcttgaagaaaatataagaaaacaaaaacaacaccccaaaagcaaaaatctcttagctgttatgtatgagccaataagagccaaatctcatagctcttatgacagtggactgatggtttccctgatatcctgctcagtggagtgaccttggcattgattaaggtattagaaataacgcattaggcttcatgaaagagcactcctgccctttgcttcctgttgtggtctctagaccactcacaggaaagcaccaacacaacagttcctatctgtgattccaaaggagggccgttttctcacacttttttatatcttctgatgggtcaatggtttctggcttttaatggtgaactgccacatagagaaacaagcacattggctaaaatagttgactgtcagttgacaggaaaaatgaaaatcatagaaggttgctattttattgccatctgttgatccaatttttgatagaattctcatgctatgattttacttcattcattcattcttacacaaaatatttcttaaatatttgttttataataggtgctgttatgagtgccgaggataccatggtgattaaaataaagacaccaagtctctgcccattaaggttcaaagtctagtgaagggaagagataatgaacaaacaatgtcagttatctacaaggactatgaaaaataaacatgttgtacgtggattgagaaagatggggatgaaaatagtattttaggtaggctgggcaggggaaggctttctggagagatctttgagcagagacttgactgaagtgaaggcgtacgtcccagggaattgtaggaagcgagttccaagcagagagaccaacaagtctgaagactgagtgtggagtgagttttgtgtgttcacagcccagcaagaggcccaaggtgcctcctattaagtaagagaggacagaaagtgtaaggcagagatataagcagaggccaggccatctattctcagaatgatgggaaagcaataggtttaattgtcagtgtcgtaaattaaatcttacctagactttggccaagtcccatctcaactaaatgtcaccaagtagagaatggtggtatttatccatgcaccccctcccacctccaccaaatggctttcattaaaactgaatttctgcccaggtttacagctagggaaacctaaattcattctttggaaatatatagcaacttagaagccatggcttccaaacataaaacgctggactacatttaaaactagaaaaatgcctgtcttattataaccatagtattatttctttaaaaatgaaacaacagaagtaatccaccccccaccaacacacacaaaataagcagatcaagccaaagacctctgtgttttaaacaaccttcattttaggcaacaccaggagtaaacttcctcaaagaaacctatttgaaacttcagatactctcagcctatgtggatcccatgacaagattttggtattttggaatatatatcaaattgttctttttggggagacaggagtgctggttatgtgcacgtaattatgattcagagaagtgtttggcaagtttagccatattgcatcttggagatgtgatgtaattatgtagttgaacctattcatctctttaattactcttcctccctaccagaaaaaccgctctgtattagtccatttttatgctgctgataaagacatacccaagactggctaatttataaagaaaaagaggattaatggactcacagttccacaggtggctgggaggtgaaaggcatgtcttacatggtggcaggcaagagagagcttgtgcaggggaaatcccctttataaaatcatcagatctcatgagactcattcactatcacgagaacagcatgggaaagatccgccccccgtggttaaattacttcccactggatccctcccacaataggtgggaattgtgggagctacaattcaagatgagatttgggtggggacactaccaaaccatatcatgatctattggaaaacaaactatattggcaagccggctcaccacaatatactaaataatgtgttatactaataaaaggaaatctaaatatcatctttaaaaaaggaaaccaacaaccttggggaattatacacccagacaatatagagtactggtggtctttttgttctgtcataagttttggcccaaacggcaacagtcccaaaggcttcacatccttccatctcaggctctgtatcttcttggccagagtcctcctatgaggctgtcttctgctgtccctcagatggcacttccattgggtccactcttctcaaagacctcaggctttgggggtcaccctgatctgcgttattaacttagccatgctccgtttccctagtctataaaactgaagtaataacattcattgattcatgtgtcctttcaacgcatagttgcagagtgctttctgtactgcagatctgtgctgtgcgctgggcatgccatggcctgtgagaaaggaatggttcttgttctcatagcatgcacagcctggtatgggacacagactgttaaacagcaataccagatgagcgtaataaaggctatggtaagtaattaaggcctcagagaagcacttaatcttatccacagcatcagaaacaaatgtgcctgactgagtgagtgctaagctaagatgcaaatggtgaatgggaacttattaaacagacatgaagaagcctgtgtgaagacccagcagcaagaatggtcttggggactggataatagatggggttttagaatagttggggcaaagcctgcaagaggagaatgtcacagaatgcaactggagaccaagggctcaagtcataaaaatcctttaaaatatcccaagagtctggattataccaaagggccatgggaatatgcgatgcttttaagcaaggaagtcacatcatccaatttgtgtcttagatcctttaggtccctgagtgaagaatgaattcaagtgggacagttcgtggcaggtagaccagttagggggctgagaaatctaaataagaggcaatatgggccttgtcctaggttgggttcccttgaaagtagagtgtgaggcacagaattggctggcaggttatttatttgggatgtcattcctggatcccagaatggaaagaatgagattagaaagggagaaaagaaaatcagtaaaagttgctttaatgagctggttgctgctatgggcaactggagctcattcctactgggagccttctaaggaatcacgtagaacagtggttcttgaagtgtggtctctgtaccagcagcctcagcatcacctgggagctcattagaaaggcaaaatattggattccaccccagatgtactgagtcagaatcactggagacaaggtttagcaatgtgtggtttaatcagctcttcaggtgattctgatgccctctaatgtttgagaagcgcaggcacagagcaggcctcataattgccccactggatcggaggaaactgaggcagaggcagagaatttataccctgactcctgtccctcagtgatggacaattgtttttcacatgtcaaggttgcaccagtaaggtgggtaaaggctcatgacttctgagaaggcctgagacagcaaagagagggccgcatccccttagtgcagtgtcctggcaaagtgtgtggaggtggagctgtcctcccagaggtgctgaagccgggtggacagaggggctgtgcccctttcccacataaccagactactcactgtgactggggtgtggcagtggagatgcagagaatttgaggatacattttcaagaaataatcatcagcacctgataaaaagaaatgaaagaagaggatatgaaaggaaattccatttttcttttttgaggaccttaatggatggtgaacaggaacaggtaccattttggaaacttgaattagaggtacctgtgatataagctaatgatggaaggatatggtgctctacacaccaagggaagataaaggcaatcatcgtgatgggagtgggtgaaatagctcaggaggtttgttgagtaagatgtggagaagattgaagacaacaccctgagaagaaggagagggccacagtgggggatcctctctttaataagcaagcaaagtaagaattgtcttgagggcaattctgggaggggtcaaaggatggaactaggagtacgtgaaacccactgagtactcaggaaatgctcactttcattactaagtgactccttgtgggggctcctgattcttttaggacaatttcttaggctgccattttgtagaaaaaaagtatctaggtcgaatattaatagtttctttaaaaaatatctgcactttttaaaaaataaactgctgcttactttaaaaaattgggaactttgttgtccctagggataatggtcattctcatatgcttagagcatatgagaatgatgtcattagttacatgttaaacactgggtcctcattcagacactcccctgccctggaattttaatcttagctggtgatgcagctgtctcaaagtgatgacaacccccaggggaccatatgcctgttgtcttcacattaggctctgggcaggcaaagaaatttgtttagaaacttattactacttttcccaggaatccatcacctctaattttgccaggcagaactcaacccaagcatattcttaaggtgtcagatctgaggggtgtggcctcaggtcttcttgatgtaagtacatggatgttcccagtcttagagttcttattgtaactcacaagttcactttcatgaaagggacctacgtattcactggtacacgataataaatcacttagggattgaatatttacattcatgacagtcttctgtcaaaatttaaaggaaatgtatatgatttggcttattcatgcacttagtaaaatatagcattttcctcaaggtggtctcaagttgcatggtatatcagccaaagaccaaacatctgagctattaattattctctttgctataaaaattaagaagctcacttactgcagaagcttctttcttaggtcttcatgtgactgtaaatcactggggtatctgaagagagaattccaatctatgagcaaagaggtgtacgtgggaaatcccctggctactcctaccagggtcagaaacagttttcaatgatacggggtaattattctactaatttagggaccgtttttatctgtaactaccttatacttaccgtatttctatggttgtttctcatatacacttctttgatgagattttaaggaacatttcgttggattagaaccaaattgaggggaggagtaatggatcaattatgattagacatgcttccagagggaatgcaagagattttctaccctgtccattgatgagcaatttcttgctcttggcagaacttgagccaaatggagcacagaatgtggatggctgcagattttccttccaccctgcagagaataattttggcatggtgtcttcaactttgtcacctgctcttgagttgattggtcacttttactagaaaacttagctctaaataatctctaccatatttcttagagataatttcctcactcagagatagtcattccttattatcttattttaaatatattttcattttcttaaatacattttgtctccgaataccatctacatgaagtaacattgcttatcacttaagcaatatctcagaaacccattggctgtgtaaattatttatttcatttgcaagttgggaactttgctcatcaagaatatgtcaggccgtgcgcagtggctcacgcctgtaatcccagcactttgggaggctgaggctggtggatcacgagatcaggagttcaagaccagcctggccaagatggtaaaaccccatctctattaaaaatacaaaaaaattacctgggcgtgatggcaggcacctgtaatcccagctactcaggaggctgaggcagagaattgcttgaacctgggaggtggaagttgcagtgagcagagaacatgccactgcactccacctaggcaacagagtaagactccatctcaaaaaaaaaaaaaaaagtaaaagctaaacatacctgcatttactaaattaatcaacactcttacagcagttaatatctccacagttctgagaacttttctaatcttaatttatttgatcatcttaacaatccttaaaatgagttccataatcatctccaattttcagataagtaaattgagaccaagagccattttacagtttgcacaaaattgcccaacaggaaatagaaaagctggacaccaagccaatgtgtttaacacttggctttatgctggtagtcattattttctggtgcttcttcatgtgtaaatcattctacagaaagtaaagctagaaaattaaaagcaatattttctccagaaacactgcggtgaattccatctctggctgcttcttgtgtcttgacattttcccttcctcctttgttattttatggccaaagcgatcgtcacgttggctcagatcattgtaacaagcttctaagccccttgctaacttaggccctaaccatcttctcagtctatcatatgtggcagctgagttcctatctacctgtaacacataggctcacatttatgtctcaaaattaagaattctgtatcttgcaaggctgatgagattagccttaccaggaatttctaagtatctactatatggtgtagataattcatctcttctcacatagtttatgactgcctcactgaaagtctaccctgtaatgaatcgctgatctgctgggaaagatacggggattagaatactttcagatgctaccttttctaagagatgtgatacatattaaaatcctaatggcttatctcaaaaaatatgctttctttggggagatatgttttaagtgaaatcatgtttatgttttaggtagggatggttctttacagcacctcacaacattcaccagataagcagtcacttaatatcttgttttttataggcacactagaaaacctttatggtacttcactgcaactactctccacagtccccctttggcccaccgtggtgctgacatctggcataacggactatgtgttctcaccagaattttgggaaaagttcagtcccacattgtattctcgattgcctttacgaggtgcctgttatttctcactttatctcctggtagaggaaaaatcaacatcgaatactttgaccagttcacatccaagatgaatacttatatttgataattactatttgaggcacaaatatatatttgatctacttttttttttttttttttttttttgagatggagtttgactcttgttgcccaggctggagtgcaatggcattatctcagctcactgcaacctccgcttcccgggtccaagcaattctccagcctccgcctcctgagtagctaggattacaggcatgcgccaccacacccagctaattttgtatttttagtagagatggggtttctccgtgttggtcagactggtctcaaactccaggcctcaggtgatctgcttgcctcggactcccaaagtgttgggattacaggcatgagccaccgcgcccagcctgatctgttctttaaatggtgattctgattcaattttccattgagggaatttctgtatatttttgataacacaattaaaagcaaaatattccatccctttgatttagtcaaacttcctccctcgaggccagttttccctagttcaaagggcttttacctgtgacaaaagctcattgatatgaatcagaaaatttttcagcactgaaattactcccttaatttgtcccaaactgccaatagtgtttttattgtcccatgtgtatgaaacagtcttcatattttaatattcattaaaatgattcagtttcttagaatcatacctttactcagtttctggtctagtcttaattactggtgacatttctctcttttcagttcctcccaagtttgtggttcagccacgggaccaggacgggatttatggcaaagcagtcatcctcaattgttctgctgagggttaccctgtacctaccatcgtgtggaaattctctaaaggtatggagttacttgatctacttgttacctgtcaaacatttgctatgttctaaaggattagataagcatttctagatttccagagaagtttcttgcaagtagatacgtatctctgtttccaccaagcctatcattctctcatagacattcctagttgtccacctaggtgtttttattcagacacacaacgtgtctgttgtacataacatgcccttggaaaggccacagagggatggaagtcttttgtgtagattgtttcagcacttaggaagtcctaccttgcccacctgtattacataaccatggtctgcttagagatcactgcacactcgtacatgaagagatgtgagtttaaattgtcagaactactcatagctggaaaactatttccccagtatttagagagatgagtgggtttagaaagttaaagataatatcattgattgttttattccccttattaccttagaatatacagattacacgtcatctccttggcgtgctctttttaaaaacaaacacgcccaatgtcctattgcgattgtctcatgttccctgcttgcacccctaatcatgtttcctcttctaatgcagaacagtagctcctgggttttaggtgacattgtagatattatgcaagtagaaatgtatgacatggaaacgaagagtggaatcatgttagactttggaaaaacaatttctgttcattagggtggcttcttcagaacgcctccttaacggtacttgcaaacatattggaagttctctttcttttctcatttagacacttgaattcagtactatattagttgagggccagatatgtactggtgagatcaaataatcagtcaatcatgacctttttttttttccaataacctaagacctagtatctaggtttaattattgtgaggtatttgtatttgtgttgacttaatcatcatttatactctagatctttcttttttaaaatagcatgttgcattttctcattatggaagcaacaatgaccaaaggaaaaataaatggtacatttgttgcaaccctcctggcatctctcttttgagaaggaaggtaaagaagtggggaaggttgctagacactgtctgattgggaaaatagctaaatttttaaaagtccctgaagcaactcccctgtcacacaccacacaccacatccactgtccatgtgcaaaggacttcttcaaaaataaaatcctgttattcagagtctctgcccccatgactttttatttcctgccgtatttgaagctccattgtgcattattacatggaaacagataaacatcataaatttaatttagtttctatggaagtgcatatttgatattatggacattttccatgacatttgccttcttcaacattatttttaatgcctgtcgttatgcaggtgttctctctctccctgagggtgtttacagttttcactctcataaacactccagcaaatgaacactcctgtatgttaattcaatgcgcatatgtgtaagtgaagtgaaaaggcaccagccatatacaaggctcttactctgtactgcccaagggcacttaggccaccaacagtatgggtgggtaaatgtggcccagcatcctcaccaactagataacattttttttaaatagtctttacaacctgatggttgaaaatgccctctcattttaatttgcatacttagattgttaatgttgtttaacatgttttatcttatgttaacagaccacttctacttctcctttgggaaatttcttattcatgttacttgcacgcttatctctatgtcttatttatttggaagtgtttctacatagattaaataatactttgtctgtcttggatgttactgacattttatcccttcttaccactaacttaaaaattaggttgtaatagtagcttttttgtctttaaatttcatatccaatatcaagtcatcaaagaaaaaaattagaaattgcaattttttaaaaagttaaattccccccaataacatcactcaaagatgatcaaagataactgctgcaaacattttttgtctctagactgtcagtcctgtccccaagcaattgcatacccatagatacacattatacatttttaaaagtttgatgattgttgctggcttataatctttcttcagtcaacaatatactatgtatgtcttgccataacaacaaatatggtgcttaatatgacttttttttttctggagacagagtcttgctctgtcgcccaggctggagtgcagtggtgcgatctcagctcactgcaacctccgcctcctgggttcaagcaattcttctgcctcagcctcccaagtagtagctgggattacaggtgtacaccaccaagcctggctaatttttttgtatttttagtagagatgaggtttcaccatgttggccaggctggccttgaactccgtgactttttaatgtctgtgtaatgtttattgtagtacatcaataattacgtttatctaattactttagttaagattgagttcagccacttaaattcacaagggtttatttttctcataagaggactctggatgtcgacagctcaggactagtttgttggcttggctaagtcatcaggcacccaaactccttatgtgttaggaagagttctgcctctcctagcagcattcttcatcctcaaacgatggccaccaagctatagtgtcaacttcctttcacatttccctgtaggaggaagagcaaagggagatggctgcccctcccacacgactcacctccctttaaggtcctttccagaagtgcatcacagatcaattttgccagcatctctctggatcgctggccgggtcgcccctggctataaagggtccgtaagccatcatggacataatgtgtgttattttcctaagtcagagggggtgttggatacctggcaactggatatctccaacactattgttgaatgtcatatttttggtttttgccagtttttcttttagaaaaatatcgtaatgggccaagtgcagtggctcacacctgtaatcccagcactttgggaggccaaggcaggcggatcatgaggtcaggagatcaagaccatcctggctaacacggtgaaaccccgtctctactaaaaatgcaaaaaaattagccacgcgtggtggcggccacctgtagtcccagctactcaggaggctaagaatggcatgaacccgggaggcggagcttacagtgagctgagatcacgccactgcactccagcctgtgcaacagagcgagactccatctcaaaaaaaaaaggaaaagaaagatatcataatgacttctaatgacttctgtcacatttatctttgtatatgtgttcatttatccctggggataaatttctataagtagagttgctggctcaaggagtaaataatttttataactttcaatatgtattgacaatttgccagcattttattcatttacacaactcacctcagtttgcagtagtgtctgtctcttataaccaaaataatactggatattaggctttttttttttgacattttccaatctgatagagaaatatggtatattgttattttaattatgcaagcagtaaatctatttcttaagaacaatttagccttgcttatggaacatgttttctttcaatgaaatgatcactaagagctgaagtgcagctccctcataaatgacaaaactgtataaacaaaacagattcagcttgtttccttgagagatgcaacagtttaattcaggggaggcagaattccagggtaaatcactgcagtttaaaggtagctattgtagaaatgaaacaatctttgctacaaaaaaaaaaaaaaaaaaaaagtcattacatttttgaccttgggtctagatacacaaagtctgagacattcagttctcttttttgatttatttatttacatgaacaaatgaggcctcttgcctaaaagagatttaaaaaaaaaaaatcagggcttcattctgaggtgggtctcacctgtactcccagaagtccacagcttaatgccattctcttgcatgtatgtcacttatactggagggaaaatagttcagggccatctccttgttacctgctgagaagcgaagagggactgcaaatgcgagagaatagatgatgcatcagcctggggcctggcctgggcctcctttgctctctctggctgtccatagagtctctgaccttcagggaaacttggttgtgggaatgtccaaaaagaagagtcagagcatgcctggggggtgacgctggaggacaatggggagtagtttgcatttaaaatagcattgtcaaaataccccaggagtagggaaagtctgaggaaagacttaaagacagatgagtcctgtgctcctgtcctccgagggagaccggaaggtgaggggccagctagttcccaagagttgggggtagggggcgaggccgggaggttgatgcctggaatgatccagaaacaccaaggaggacattacagctgtggcagagttagtgaaaggaagtcctgggagaggagactcctgcactgggtccccatcagtcattgtaaggacctggctctgcccaagtggggagtgggtatggtgagcaatgagagtggtgatggtgatgcggtctcttcagctgctgctgtgctgaagccagaagctaggaggctagctgggtaattggagagagatggtgtgatctgcctcatgctttaaaaggatcacactggcatgctgttttgaaagcagactgtgtgaaggacaggaatttcagccggagagctgttctaaggccttggccgggatgtggccggaaccagggtgactgcagtggaggagggacaaatggattctgaatgtctttgagtgatggacatactatgggtgtgacaaaaggggagaaccccaggcagtgaggatagtggaagtgccggtgacagacaggacgactccaggagggcagacctgtggctggggtaagatcagggttttgggctcctctctatgcagatacagctgtcaatttccaatataagcaatgataaattttctaaatatcctagattttgatgaatattttctgcattgtcagagcttagaccctctatgttctgttctgcagccatatgcccaacttttgcaattgccagttctgtgttagattgattttgtgctcagtatgagttatttggacatagtgaagaatattccaacctctttctggtttgcaatggtttgttccttgcctttttacacccaaaggacagatattggcggctcacactgtctccttggagggagcacagactgcctgatttccctgtagaaggaacttaatctttttggttctgtgcaccaaagagctgactttgaagtctggtagtttattttctttttttatttttgtgatggagtctcgctctgttgcccaggctggagtgcagtggcacgatcttggctcgctgcaacctccacctcccgggttcaagagattcttctgcctcagcctcccaagcagctgggactatagccatgcactaccatgcccagctaatttttgtattttgggtagagatggggtttcaccatattggccaggctggtcttgaactcctgacctcgtgatccacccaactcggtctcccaaagtgctgggattacagacgtgagccaccgcacctgccctgaagtctggtaaatttttagtctataatttggtgttttccatttggggtcaattttcccatagatgtggtgcatctatttaatatgtagattcaggttattttaaaaaatatttttcccatgaattgtatctctaagtgttctcttccctgctttaattttcttcttcagggtctctgattgtggttccataggattgccacctagtctctgtagctgtcattttctctctggttttttaactcattgatttccattttaatttgttcgatatttttccatttctgttctccatgtcttttccccagcaaggtctgttcttctttgtgccaactccggttctgccttcactgctgtgagtttatattttttctccttctttctctccagctctgccagctcacagttcacccttcttcagccatggctttatagacaagtgactgttttattcacagtcttcatctaagtcgtaatacctggtttcttgttctgtttttttcttctattttgcttattgtatctttgctaggtcttggtttcctttcgaatacagcagccccaagacccccaggggatgactgaaccttggggagcaccaaaccctacatatactatgcgctttcctacacatgcatacccctgataaagtttaatttataaatcaggcacagtaagagattgacaaaaattatgagtactagaataaaattattattacaatgtactgtaataaaagctatgtgaatgtgctgtctctgtctctctcaacatatcttatgtgtctatactcccctattttaagactgtaattgacctcaggtagcttaaaccatggaaagtgaaaatgtggatgagggggaactactgtacttacatttgaagaaaatccatgtccccagaaaaagattgttgtgtacaaatgcctgattcctcagctaaccctacttctaaaattctaagccacatcaggcctggggaagtgccacccacacccacctatgcacactgttttcactgatggaggcttggctctcacctgtgacccactctgctgggacttctgaagttcacagcggtggccctgattccctcatcttcctgcatgctcttctgctcaattaccctgttggttgcccatttacccattctgtagctggaagtttagctattttctaatttcataggaaatagaggttacatttttctaggcttctctctcccatttgctttcatgttgttcccaggaagagaagaagtgctggtttatgcctccatcttcaaatatgaaattctattgtttatatacaaagggtcattaaatttggacttgattttagtaaaataaataaagtaggaatctaggaggaggagtagaaatcatcagttaggagactgggctataagttcaaaccccagccataatacaaccctgtctggttgggtgactgcatgtaaattacctaccccatatgaaccacagcatccttgcagctgaaacagataaaataaggggataaatgtgatgatttagtaagatgactcatagaaagcatttattatggcttctggcacatagccattagtcagtatgtattagctattattaatatcattattgccattatcatgaacttacatggttagccatttgtcctaaaaccatttattgaagagcccaaactttttcatttgcgataccttattgtctaaggggaaaatgtgaatactggagtctgtgtttcagccttctctctgttacactcaattgcctgttcagcaccatacgtattagaagtttatctccttctattttaatgtctgttttgacaatactccccttgtgacttttatttttcaaaaatgtccttgctttttctgcatggatttttgtttgtttgttccttctagatgcatattaagataactttatcaagtttccaaaaaatctggaaaatttggaggatcataaatttaaagcttaacgtgaagaatgctgatgtcattagaatattgagtcttcccagccaataccatggatagtcctttcatgtatccaagtttttcttttatgaacattaataattttattgcattctttccatttgtcagtggtagtgaatttttataagctacggcatctggttttcttttgtcctccttggttttctgggcggaaaggggtcaagagctgtctacagccaatctttgttgagcttgtccttatgtagctgtccacatctctttcttctcccagcaagggtaatgctgttcttaatttagaggagtttctattttccccactctgtagctcatactaagggctgcaatggtgtgtgactctatttcttcctgtctctcttgagattgtatttctccctgccccttttcctgtgtcctttctgctcattgtagtttccccaattccatatttccctggaggctccagagaatccaccattatttggtgcacacacaggtttgctttagctcctccttctcctactgcacccagacaagctgctggaggctgtcacttctgcactcaccacgcacagtcccccagagggcctggctgtcccttaccactagggccctaaaagcaccctcttctgctcagtgtcagcccacctggagaaatcctcccctgtggttatagactcatcacagggggcaacaggaacttgattcttttgttgagagattcatagaaataaaactaggcactccagacagttaactaaacgtttccatgcaagatggaggggaaaacacatgctgtgctcaatactggccaaactgctcaggtgaccctctctggagtcccctcctactttaggggcatgccctggaaaggctcaccttgatcctgcccacaacttccctcccaatgtccaggggacatccctggaaccttctgtagtcctcatggcctatgtctcagaagaccatgagaaatatgagggaaaggacaagcctaagtccctcaagcaggttaattctagagcagattttctgccaacaccagtttcagacctctctggtgagatgaccaagtcagtcccttcctcagcagtcaagagagggctcacactgcagatcacctgttaatcacactgtgatcacactgcacatcatactgcagatcacactgcagaagaccctgcagatcacactgtggatcacactgtggatcatgctgcagatcatgctgcagaccaccttgagatcacactgtggatcataccgtggatgacattgcagatcacctgcagatcacactgcagatcacactgtgatcacactgcagatcacaccgcagatacctgcagatcatactgcagatcacactgtggatcacactgcaatcacactgcagatcacaccatggatcacactgcagatcacaacgtggatcatactgcagatcatgcttcagatccacctgtggatcacactgcagatcacaccttggatcacactgcagatacctgcagatcatactgcagatcacaccatggatcacactgcagatacctgcagatcatactgcagatcacgcttcagatccacctgtggatcacactgcagatcacaccatggatcacactgtggatcacactgcagatgacactgcagatcacactgaggatcacctgtggatcacactgctgaacacactgcaggttgtacattcaaaagataagtctggaaagaagcaaattatcaagagacagaaatttgcttaaataaaattctcttttgtttttcctctgggaaagcagggggtttatattaaaatagctcaatagggagcacgttcatagggcccagttgggatgatactgagttttcaggtcctccaaggcttctccccaagttctggtccctttgtcctgctctgtatgcccttgcatgtttcactctgcgccagcctcgtgcctgagtgcccccaggttcagtgtccaaggcatttcgtctcattctttttttgcccttgctgccactcactctgaccttgaatgccagttccacaggctttgctcagacaagtgtctcttttgcatccctgttctgagaaattgggtctctgcattgtctctgacccttgtcttggtcatctccttgggaccagtggctccaatcctggccctatcttaatcctcttagtgtggatcaccagaataaaacttctgaccacaagcctgacctggtggaggctgctgccctcccactgtcccacccctgcctgtgcatctgcacactattcagtgctctcaccatgcccattcctagactcaccatttgtcttgctctgtgttgtttagagcaccccaagactccacacccatggttttgacctcttccatgtccttcatttcctgaagcagcagtgatcccctgctctgccccagtgcactcctctgatccaggctatcaagtcctggctctcacccagcaccccgatttccaattaggtgataagatgcaaatattgaattaatatggggaaagaattcaaataatccaaaaacgagaagaaggcaacatctctctatggcacacatggtaaaaataaacccaagttcaaagtccgatatggatccctcatgcacaacaaaaggagctctgcttgtgtgttgtgtgttccccaagaagagacaaggggcctcacaaagaaataatgagttcttgaaaacaagttgtaagctgaacagagaaagtgagtgttccatatattgttttattttcttcctttgatggtaggaaaaaccttagcagagcagaaaacctgccttcctctgtgctaccctaatcagcatctcagtggccctgggagctgctgcaggacctctgcagggtcctcacctaaggaagtgtaattaccctgagccttggtggagccaccaggacagtcaaccctggggcccatcttgctcttcctttctttatttttcagcactcctccatctttccccctcatttatttcctgggaaactttctggaagccttcttctaggtgtaggcagtcacactgaagacaaatgtttggggggctcttgctccagggaaacggtggctggagaccttgaatggtagacactgctgcagggctcctcccaggagcaaggcaaagcactggtggaatctgcataattgagtcacctcaaccacttccaatatcacatgaccccttgacgagtgctgaattgtgttcagttcatggatcaattatctgataagtgagtgaagggccaattccctctggctgatttaaaaaaaaaggattcttatgtattagttacataattacgtattagttacagaattagacattgaagtgctagtggactagcaagttgtaacaaatcctgattagacactaatctagaccatgaaatttccattgttgtcattggatagccttcttcaacatagaaatgaaggtattaaggaaagatgactggattgcacagtggacacaattatgtgcacatttacaaaagaagtaacctggacggtgtcacacctggatggtgtggtgtgttatcaagaagggatttaataaagggaattaggggcatgcaaaatcctttgaagcgtggacaaactgcgcggccctttaagcacctgagaagtgtaggaactaagatgcttctcccgtcactgctaacagctgcttctagtgctcaagcagtgatttgtagttctcccacaggcagccataaacctgatgtttggggttgacccatgcatcaatttgctgcttctaaagcaaaataatggcttttccacccttgcacctacaaaattgtttttaagtgcctctcactggtaaaatgtaaaccagaatctagtaacaaagccagggaatgtagttttcaggctttcaagccctgcaatttagggcagagtttagagggaaagtggtagtgctaaagatcaacatacagcatctgacacaaactttcagtgtcataaatattacctgcacagtggtggaagcttctttctcagggattggaaatagctctccagcctggaaccaagccagtggtgtctcaggactatacctctgtccacttcgggattcttctttgtaacagaactcttcagcactccttcactgaataagcattgtatttcagctactaaaccttatttaggtgcaactgctgttgctattcttgctttttctcttatctttccattgcaacctctatctttttacccaatgctttcctgcaatcccccaactattctcagagaggaaaccccccttcctaaagaagaaaaacaaatgcattcttgaggaaaacaccactctctccataaggatgaaagggattgtgtttgattccttggtgaaaagaaagaacagcttaccgcctgaccattgtgcaaaccattggtgaggctaaagagacctcctttccatggtcctgcgactcttcagtcttatttcaccctacaaggggacccctctggatgagctcattgaccaagctctccttgcatgcaggcatttatacccacattcatacaatcttgcttcactttatgtgcacaacaatcctacatcatatgtaaatggattattctccttattcatatatgatgaaattaaggatgcagagaaaataagccacttgctgtaaggcatgggtagtttcagagagcatgagaacctaacccttttgactcttatccaagtgccctctctacagaccagcaaagacttaacagtgaaggaaaaaaattgaaacaattttcttatttgctgctgccttcaaagtgggctcatttggtgacaatctgccgttctttttccactgtccccatactctcagtccctgtgaacacagctatgcatatatttgcaataaataagaaaggtgacccagaattaatataactagcaattcagtatgtgccttacataatgctttaacattttattttcatgtaacggagcattgaaattgtccccacttgacccctgctagccacagaaaattggcagtgttttaattaatgactgctggttaccacattgtatcttctagctaattacctaaagtgcttaccttgtgctaagaagattacaggattttacatattgatgctttgggttaaattttactctttagaataaagatgaatctaaagtagatgactgataaataattctgtcaaaccctggcgaagtctacttccctccaattaaacaaatgctagcccttggaactgtagtcctcatagtagatgaatcagttggcagtgtgttcactattattccatttagtaaccacaattagatcttcagatgcaataacccttcaacttaggttcatttttctgatgaagaaaagatttaatgttttcttaaatgcatttgaaactttatttctatcttcattaggaccttttagtaataaagaaacttacttcagtctagataggaataaacagatcatccttttctgctatttaattgagacgacttagcattgtagttaattttatgttgtgattctttaatataaatgtttcaacaattacaagcatttttctggtgaaaattatttaagaaaaggaaaacaatgtgttgttgacatggatattcatgtaaatttttcaaaccacaccagcatgttatttgattttcagtttcttaaatacagttttatataatttgaaatttttagattacctatcttttttttttttttttttttttttttttttgagacagagtctcgctctttcgcccaggctggactgcagtggcgctgtcttggctcactgcaagctctgcctcccgggttcaggccattctcctgcctcagcctccctagtagctgggactacaggcgcccgctaccacgcccggctaattttttttttgtatttttagtagagacggggtttcaccgtgttagctaggatggtctcgacctcctgacctcgtgatccacccgcctcggcctcccaaagtgctgggattacaggcgtgagccaccgcgcccggcctagattacctatcttatagttatattttttcaatcctatatttggttgagttttcaggttgtgtgtattggactaaatctattctcaatttacagtcaactttgggaacgacattaatagcctttactgattttcaaagtgtgttacaaatttaagcacttaaataaaagttgaaggctttttccttaattttaacttccaataaatctattatcctcacactaatgaacacaatatccacaagaagtaatttgataatttataaaagccaaattctttaaaaatgcagtctaattttataggagaaaaaaatgattatctcaatatatggttaaaaactagctgataatattcaacatcctcttctgattgaagcaacgagaacaaaaaaagagttttgtaaaataattacatagaaacacttccttataacccaaagtgctttggaaaatgaagaaaaagacaaaagctcagtagaaaaatgggtaagggataaatgggctgtttactaaagaacaaatacagatggccaatacattcatgatgctcaaaattatctataaacagaaacaaacaaaaatacaaaaaaaatccgccaaaatgtgcaaattaaaatagtgatgtatagcattgatgcagatttaaaagtttaatagcatacatgtatgaggaaaaaattaaccctcagctagcactgaaggagataacgtttgtacatttttaaggcagtttattgtaaatatggtaatatattttaagatttgaatatgcatcacctttggtccgaaattcttctccctgaattaagcatacagattgcctaccgctatatatatatatttctctccactgatgcactgattgatgagtggagacattcattgcaacgtggtccctattcttgtggaatgggaaagacagacagccatataatcttaaaattattaaataattaaaaagagaatgttagaaagcacaacaatgttgtttgcttactataagccataccaatacatagttcaagaacttcagtgcttctaccatcccataatgaaggttctattattatttccattttacaagttaagaagctgaaatattatgtaacttacctaattttacacgttaggaatctattgctttgtaacaaattaccccaatttagtggcttaagatagtatacatttaatagcttccatttctgtaggtctggaatgcatgtgtggcttagctgagacctctggttcaccatcttcccaacattgcagccaaggggttggctgggatgcagtcatttcaaagcttagctgtgggagggtcttctcccaagctcactcctgtgatggttgataagctttactttctcagactgttgactgaagaccaactcccagttccttcccatgggagcctctccacagagcagctcacaacatggtagctggaattccccagagttaagactgagcgggagggagagagggaagaagaaaaagagatggcagtcatgatctttttagccatagctcctcacccagtatttgtcacagtacaggtgctcagtaattaataaagtccatttgcataaaaacgaaggctacattattttatgtttagaagatattagaaagtccgtaatctctctgaaggtatttacttttttactgtttgaatttttgacaaaaaattcagattccctaatccaaaattctcatgctttaaatcccaataagtaaactagtaaatagctttcattaattatttttcaaaatcaaccactcttatactgatgtatttattttttctcaagcatttgaggccaagaacaatggctcgtgcctattttcccaacactttgggaggctaaggtggaaggatcaattgtggccaagagtttcagacagtctgagcaaccaagcaagaccccatctttacaaaaaatttttaaaggcctagcggggtatggtggtgtctgccggtattatagtcccagctacttgggaggctgaggggggaggattgcttgaacccgggagttcgaggccacagcgagctatgatggtgtcactgccctccaacctgggcaaaagagcaagaccctgtctcaaaaaaaaaaaaaaaaaaggcaccaaaatctgctgtgaactttcatatgaattaaggttttttttttaattattatactttaagttctgggatacatgtgcagaacgtgtaggtttgttacataggtataaatgtgccacggtggtttgctgcacccatcaacctatcatgtaggttttaagccctggatgcattaggtatttgtcctaatgctcttactccccttgcccccaccccctcacaggccccagtatgtgatgttcccttccctgtgtccatgtgttctcattgttcaattcctacttatgagtgagaacatgaggtgtttggttttctgttcctgtgttagtttgctgagaatgatgatttccagtttcatccattttccagtttcatctattttatggctgcatagtattccgtgaagcatgtgtgccacattttcttgatcaagtctatcattgatgggcatttggattggttccaagtctttgctgttgtgaatagtgctgcagtaaacatatgtgtgcatgtgtcttcatagtaaaatgatttataatcccttgggtatatacccagtaatgggattgctgggtcaaatggtatttctagttctagatccttgaggaattgccacactgtcttccacagtggtcaaactaatttacactcccactaacagtgtgaaagccttcctatttctccacatcctctccagcatctgttgtttcctgactttttaatgatcaccattgtgactggcatgagatggtatcacattgtggttttgatttgcatttctctaatgacaagtgatgatgagctttttttcatatgtttcttggccacataaaagtctcatatgaattaagttttaaattatctacattatacaagttgctggtgtaattctgaattttgtacattttgataacttatttccaaggagggagcagatttagggataaaaatggttgtccttttagtctcactttataaaatactcattagctcaagtgaggaaaacatattgaagagataataaaatactgttatgtttttaaatgtttttatccctgactttgaattccttatgaaaagaagaattttaaaaactttttctacttagaatcattttatgaaaattcatattttagatatgtaataaagaactaatgcaaacatgtgagttttgttagtagatgttccctcttctaaatgtacaattatcctacatttacatttctcttaattacctttaaaacagatatcagaaaactatgggccacaattcaaatttggcccacatcctgtttttgtttttgtaaataagttttttagactatcttatttcctcataatgatcaccaacatttatcactatatgctaggacaaagatcaattcttctcagattcagtatttttgaagactcctcctcctcctcttcctcctcctcctccttctcttcctcctcttccacttgttttagagacaagatctcactgtcacccaggctagagtacagtggagctcactgtaacctcaaacccacctcagcctcccagagcattgggagtagctaagactacaggcatgacccaacatgtccagctaatttttaaaattttatagaaatgagggctcactctgtgactctggctagtctcaaactcctggtctcaagtcttgcccccaccctggtctccgagagtgctgggattacaggtgtgagctgtcatggcctgccaataagttgttatgaaacacaatcatgctattttgtttctgtattttctatggctactttcatgactcagtggcagagatgagtatttgtgacaaagactgtatgacctgctaaatttaaaatatttactctctggcctttacagaaagattaccaacctctttctgaaaatgttaagcatttttattcatgaacatggtataactctctaattatttaggtcttatttagttattctcaacaacttttacaattttcagtgggctggtcttgcacatattttgttaaatttattctaaatattttatggttttttgccaatatattttctttttaatttttattcccaattggttgttactattatacataaataaaattgacattgatttttgtatattgatgttgtatcccatgactttgctaaactcattttatagttatagcaacttttttgtttactcttttcaattatctatgtagaaaatcatgttatctgtcagtaaatacagttatattcttatcaatctacattcgtgtacttttattttcttcttattatttttctttttttttttttttgagacgaagtctcactctgtcgcccaggctggagtgcagcgccgtgatctcagctcattgcatcctctgcctcccaggttcaagcagttctctgcctcagcctctcaagtagctgggattagcaggagaatcacttgaacccaggaggcggaagttgcagtgagccgaaatcgtgccactgcactccagcctgggtgagagagcaagactacatctcaaaaaaaaaaaaaaaaaaattcaggttgtcgtatgtcccctctagcagttccattttgatgggaaccacctgttgtggggattctacttgatctcctcattcaatgtgaaaggtccccttaggtaccttatcaatttctctcgtctcttcagtggggctagagacaagttgctgagaaatctaaaccagaaacacgggaaaggaaggcacagccacagtctctgccattgtgagctcgagtgagaccaatacacaagttgtcattagggtatggagacagcaagaggaagtgtctcccattctcctgtcctcagatgcaaagtctgaagtttcctgcttgaggcctgtggagacgtctgacttgttcagctcccgtgtaggttcttgggccaggaagctagcaccttctctctagaacacatctttggcccaaacgttgagcttcctccaggaagatcctcaccccagagctttcccctcaagtccccagatactcaggccagagaagaaaaatgccctgggagagtctttcaaggcctgaatcccattctcccagcccacccaactcctccaggccagaagcaggcagcatggcaggttcatccagtcaccatcttcccagaagtcttctaggaccttcataatctgtttcattatttctaaaatcctttttttttttacccagttgtatataaatccttcatatgaatcataccacattcattataatagcatatcatatctgtgccattccctccttgcatggaagcactctgaggagagaggtgttttaattctgtgctgtcttactgcactaatctgatgtatttatttaaataacattaaatgatattaatggtgtattgtgtgtctagaccggaatataaccaccgttaaagagaaacctgcaatattcctattctctttgtagcctcagacatgtgcagtgagcaaagacttcaaatgccatgtccctggagcactccttgtttacattcatattaagtccctgggaacacaaggaatttatttagcaccatgagagttgtctgcttctgtggttgttctactgtgatttctttgaataatttatcagctacttaacactcatcaaatttggctttttatgtagagaaactatctgtaagttctgttagtttttatctcagagtctgagatactgtcattttaaataaatgcttttctctctaaacaagaattttaatactggaggaaagaaagaaaaacctggtgtatcccgtgactgccttatgggatcagtgtgaagcatctctttatgagtctgtgtgtacttgaactcgttgtcttcccatacttactctcgtttgcatcattgctcgtctttctttttctgtctcaggtgctggggttccccagttccagccaattgccctaaatggccgaatccaagttctcagcaatgggtcgttgctgatcaagcatgtcgtggaggaagacagtggctactacctctgcaaggtcagcaacgatgtgggcgcagacgtcagcaagtccatgtacctcacggttaaaagtaagagagaagaaatgcttcgttttacctagtttaaatacataggtctctgggggcttcctttttcaattgtctccatacatacctgtttaaaagcaacacaaaagaagacccgttggtgtgatatagctgggtttaaagttttgttgttctggaaacatgattgaagaggatggtaaacatccagctaattgttgacagtgtgcccagggccccttgtgtgtggagcatgagccacattcttctcttcctttggttctcacagccattggtatgggctctgggcaacctagcagatgagtaggtctctgcctttaacacccacattgctaccctgttgattttcccgtggaaaaactcaatacatggtctcagatgtgctctttacaaagccttttgtcatgcattttgttatttgcaagctgtcttgtccatggatttccttttaaggatcattttaaaatcaagtgactagcgaacaactacaagacagaaatgtgtaagactaggcttaatgctggcgctgctggcccaatatatagaaaaaggtgcgttataatgaaattattctcatacattggtaactggcaaccaaggaaaggatataaagtgaaccagttttactgagttgtgcttattaacaaaatgatggtgcatctagtttacagtgaatggcttatgcccatttatggaattttccatcgaatgaactgtgatttcttcttgattacaaggctttattcagactcccctcccactttttttttgaggcagaggctcactctgttgcccaggctagagtgcagtggtgccatcaaagctcactacaccctcgaactcctgagctcaagggattctcccacctcagctttcttagtagctaagactaccagtgtatgccactgagcccagctttttttttttttaattttttataaagatgagggtctcactttgttacccaggctggtctcaagctccttccctcaagtgatcctcccctcttggcctcccaaagcactgggattacaggcataagccactatgcctggcccttggatttcctcttttttttaactttaattctgctatggatagtttggaaaagtctctactatatgatttattagaagaatgagatttaaaagtggcattcaggggtgtgtgtatttgtgtgtgtatgatattgaaaggctagctaaacagacaagtatccatcctaactcacgaagaatttattttagttagtccactatttccaacagaacaaaaaaaatccaagtgtttatttattaaagttttatattgtgaaatggattataattatgaaatggggttgttttggaatatattttgcacatactcaatacctagtttttgacttttaaatcgtatgctctggaggaaatgatgtgcaagaatttgataacgaattgtggtactgtttaaatccagagctgaaatggtaatttttaaaagttataaaggaaacctaaaatctgaggagcaatgttgaccagagtcggtccatctttccccaaggaaaggggtgtattttgcagttattttaatagactttaaatgcataagacaattttttagtccataaacacatatctaggacccaatatatataagaccctatgaaggatacaagtacaatcaaccatgggccttaccctcatgagtgacaagcctcatgttttggaaggggagataaccaggaagaagatagaagccactgattacaatgcagggtgaagagtcacatggatcatgtctgtgacattcagaggaggatggaaatgtcagcttgggggaattaaggaaagcttcatggaaaataggcttcaagaatggacgatgcccccatatgtcctctctccagatctcggtactcagtggcagttgtgcagcatcagggaggactaaggagatgaggtggcccctgccctctaggagcttttgctctctggggataattgagtggatatatgtccaattcctgtctggcagaatacacaactggtggaacagagcccagaacaccagggttcatggaagagggtatgatttgcttctgtttgtagaatcagtgaccgtgtggaatgaactgaatgtctgtgtcccttcaaagtccatatgttgaaatcttaccgccagtgtgatgatactagaatctgaggcctttgaaaagtgattgggtcacaaagggggagccctcagggatggaattagtgtccttatcgaagggaccccagagagctctcctgttctctgtttccaccatgcgaggatatacaagaaggtggcaacctggaggaggatgctagaacctgcccctgctggcagccccatctcagacttccagccttagaactgtgaggaatacatttccgttgttgataagccaccaatgtatggcactttgttacagcagccccagttgactaagaaactacggaacgaaaagctgcagcatctgagttcggtcttaaagacacaagggccttcaaaaggcaggactgttgaggctagatagggtattccagggacaggagacagagaagccagatacaagaaactgaaagactccaggcaagagtaactctctgttcgaatgttctacagtacatggaggagatgggagaggagaacatttaaagtgaacacacttcaaagagagatgatagagttggccaaattttagattcttaaactaatacaagctagtcatggacaggtggatttaaataagttaaatgcacctcttcatgactgtttgtattagtttatctctctaggcctagaaaataggaagaactatgccatcttcatagagttatcatgaaaattaaacagggtaacacatgtgaaaacacattgtaagacataagatactctaaataagtattccaatacatacatagagtaaatgattctttggttggaaagaaagagaaaatgtatattgatggcacagtgcataggagcatttccagaaagttattctgaaaaaaaattaaaaggccagaggctaggaaaagggaagaagaaagaggacctccatggcccatggggaggtattttcatccttgtctaatactcgtccaaagctcagccctggagtggtgtctttagcaactctaatggccaatgtcttttgcctaaccctagttgtttaagaacaatcagtaaagtgttttaggatctcaaactgaaaaaaaaaatagatataaaggagagtttactggtctaaataaacacattaagtactctcccctttctgtaagtcattttaaaaaatgggctgcaaatatttctaaattcaataggggagaccttgctgtctaattggatgatgtcaggaaattaagacagctgctcctgcagcaagtctggactcccaggatggcctggtgctggctgtaaacataatttaaagacccaaactctccggataggacctgcttctgggggctcactgtgagatcctgcgaaccctgcacagagggtttctcctatatgggaaattttcttactgctttcaagaaacatcactccaaaaataaagcattttaacaataaacacccaccacatacacacacatctttttgttgttgttattgaatcaagcataaggaagccacaggcaaagaagaaagccagcaagcatgtatggaattgtcatggaaagcaatcaatgggatggaaggttactgcatgcaaatctttccagctctgttggggttcctgtctgtgagtctacactgtcatcacaattctggtttatgttttacccaaaataattatcatgtgagataacgattaggaggcttggcagaaaaggcagagggagtaggctctgcttgcaatcaaatttggcctctggtgatgacatcctgccctatgctccaggccgatcgggggctacagaagctatgccacttatgtgccccttcccccaaccaggaactgtttgaggcccagggaatgactttatgttaaaaaaaaaaaaaatagctctgtcaatcgaggaaaataatgagacaagtctcaatcattttaggatatttatttgccaaagttgaggatgctcccaggagacaggtctattcctttctccgaaggtgattttgagggctccaaatttaaaggggaaaggatgagatattgagaagcacacagctttcacataaacaaaaggggcagaggaaaactgtggggaatgtgcattttacataccacagacaaaatggagaggggaacgttcagttatacatttgtgtctggtgggcagagcgactgcacctgtaaagataggctatcaagttgcattgccatggggaagctttaacagctcaccaggaatttccttgtgggcaaaatatgagggaagcgtgtagcttttcatcttgtagccatcttgtttaggaaccaaaaggtggaggcagatttgcgtgacccagttcccagcttgacttttctctttggctaaacgaatttggggtcccaaaatttaatttcctttcacagctccaaaacccactgaatctcttaaatggatagccatccctaaggtttgtctcagatgcccaaattacatcctccccgctcccaactttctgccactggctgatctgaagcctcgtgtttccgggaacactggtttcagcgtgaacctgtggcccacagtgaacaagccgctctgcttttgtgagctgctctgcataggtcctttctgatccctgcatgcaggacaaaagagcaccgcttatcaaacaggaacaggcgcttccctggagagtcagttactcttggaatctagtgaacccccaagctcccaaagttagcccgtgggctctagtccagcctatgtaatgtggtctccctcctccatgctgaatccaggaaggtctgtgggtcgctgtgcccatcagatttctgtactgtcagaatgcaagtgcacacatgtgcatgcaccaactcactcagctctgacctgaccgtctgcagggtcttggctatttctggacagatctccatgttatgatttgacctcaggccactctcaagccctgccattgccagggcagatatgttgggcctgacatataataacccatctccttttctgttgaaaacatgtgtatctatgcctggataatccatagtcaacctcctttactttctgccctcacccactgccaccagtacccacaaatctttatcctaacccctaattagctaaatggaaatctccagtcccggtagcattgctctgtgatacttcttggaggaggaagtagcccagccccaagctgcccccaagcggcccccaagctgccccccatggtgaagctttggccaccttgaattaaccccacatgtttcccaggctctttatgatcactcagtctgctgagccaatcacctcccaccaagcccctcttccaacactggaattaaaattgagcatgagatttgggtaggaacacagatccaaaccatatcaatcatcatttctgaattatagtttaagtccttcccaaacatgacaaattagtgcctgaaatagaatatgaggtgtcccaggtttgtgaacacccagcttatgcactttcctaaattcagtcaccagcacccccagcagtcctcccccaacaatttatcctgcacatatgcaacactcagatccctcctgcttcactctcaagtccagttgccagatacgtctgcaactttgctgggagtttttccaaggaaggagtctcccgcagaagcttcagagggactgcagctgtgccagcactttgattttgcacttctggtccccagaattgtttaagcataaatttctggaggcagaagcagagaatgggaagaatccagggaacgtaagtgtgctggaggggacattgcttagtgaaggaaacccctcagcagctgccacgcccttggtagggcatcctgagctccacccaaacatatgcatttcccttcctaagtcagcctgaagttccaccagctaaagattctctggggtaaaaaaggaatttgtaaaacaggagggtccatatagcagatgcaatttgatccctgctccagtttcaatttccctcctttctctgtgctaaaaattgaattatttcccgtccaccccctagatttgtatgttgaatttgtaacctccagtaccttatatgaccatatttggaaatagcgtacttgcacattgcaggtataattagtgaagatgaggctctactgaagtaggccgccggatccctaatccaatatgactggtgtccttattaaaaggggacaatctgggtgcagacacagatggaaaacatagctgggcaaagacagagattggagttatgctgccacaggccaagagacactgggcaaggcaaggaaggggtctcctgtagaaacttcagagggactccagccctgccagaactttcattttggacttatggcccccagaaagatgtgagaataaattgctgttgtttaagcaccccagtttgtggaactttgttacagcagccccgggacaccatacactcagtgacaacagaactcttttgcggtcttgtgttggagggaagcccaccacaggccagatcccctgcctaagcagaagagtccgaatccatcaaagccactgggtgtgagccctggccgggacccatcaaacgcagcagctccctttgattgaaggatgggcagacaaccagaatttgcacaatgaaacgtaaaaacaattcttttgaggagtttctggagaagatttccgtattcttaatacgggactctgcaaaagaggtttatcccatttaattcttgaccccatgatgtctggcagtacatgagatcacctgggactttattgcctttgctgtctaggccaatgtgggtcagggtttttgcatttgcagctggaggcatccaaactaattagctaaggagagagcagcatctccaattcatggagtgcgattcagccacagtgttcccctcggtaatcctgctgaaataaatggctctgggggaatgaggagttagatctggattgagaagctatagggatttgcagtgcatgctttgggctggggcagaacagctccgtgggaggatagctgaaggtggatggcagcactcggacctgggcacatatggtggcttacagcagggagctcagtacctggtgagggaggttctcctgcctcagcttcccgagtagctgggattattatagatgcccatcactacacctggcttatttttatattttttcagtatagatggggtttcaccatgttggccaagctggtctcaaactcctgacctcagttgatctgcctgccttggcctcccaaagtgctggaattacaggcatgagccaccacagcctttcgaaaaattactggggccagtaaaaatcttatgtttccactccactgttctcctcctcctcctcttcatccttctgttttgaggcacccttctaccaagcaactaaaatgttattattttttttaactttggggtaattgcgcctatttcaatgtttttcagttgatttaaggtccttctgttccatggccttcccctgtggccagtggcactgatgttctgaaccctcaatcagccattaccttccacactggcatctgctgagaagtctgagtgccatatggtccttgactgtggggtcactgcttagttcccttggaatctcctcctgtcttctggctgcccctgaccagacccacccatttgcccatcagcagggttcactgaatgctccctagtgtcaagaattgttctacatcctgcgtgctctgaataagaccaagtattagttcaccgtcatgcagcacaaattcccttgagaaagacatggagatgggtatataacataatgcctggcagaggatacagtgatgtaagaaagcaaggtgtgcatacgtcttggagaaagcattccaggcaaatgaattagcaagggcaaaggctgaagggagaaattggttacatctgtggagcagcagggaccctgtttgctggaatgtatatatgtgtgtgtatttgtatatacttgtgtatatacgcatgcctatgtttgtatatatacacatacagtatacatagacccacacaatccagatttttctttctttttttgaggtggagtttctctcttgtttcccaggctagagtgcaatggcacgatctcagctcactacaacctccacctcctgggttcaagtgattctcctgcctcagcctcccaagtagctggacttacaggcacctgccaccatgcccgtctaagttttatattttagtagagatggggtttcagcatgttggccaggctggtctcaaactcctgacctcaagtgatctgcctgcctcagcctcccaaaatgttgggattacaggtgtaagccaccacacccggcccataatccagattttatgttatatagttatgtgctgcataacaacattttggtcagtgatggaccacatctatgacagtagcccttaagatggagctataatggttaacatacatctaatatatgtgataatggacaacatcctaacattgtaacttaatgcatgactcacttgtttgtggtgatgcttacataacaaacctactgccctgccagtgtacgaaagcagagcacacattatgtacactatgtaatacttgtgataataataaatgactattcatggtttatgtatttactaattgttcataattactttagactactccttctacttataaaaaaaaaaaaagttaactgtaaaacagctcaggcaggtccttcaggaggtgtccagatgacctgttacttgttttttcattttttaattttttctatttcaatagctttaggggtacaagtgactttgatgacatagatgaattgtttagtgataaagtctaggattttaatgcacctatcatctgagtagtgtacattgtactcaatatatagttttctatccctcacctccctcccaccctccccacttctgagtctcccgagtccgttatagcactctgtatgcctttgtgtgcccaaagcttagctcctacttataaatgagaacatgcattatttgctttttcaattcctgaattacttcacttagaataatggcctctagttccatctaagttgctgcaaaagacattatttcattatttttatggcttagtagtacttcacgatgtgtgtgggggtgtgtgtgtgtgtatatatatatatatatatatatgcatgtgaaaatttcaagatgatatatatctaacatatatatatacacacaagatatacaagattaatctatatataacatctttatatatataaaatttcaagattatatatatatatatatatatatatatatatatataaaacatctttgtccattcatcagttaatggacacttaggttgattccatatctttgcaattgtgaattgtgctgtgataaacatagacatgcaggtgtcttttgatatagtgacttcttttcctttggatagatacccagtagtgcgattgctggattaaatggtagatctacttttagttatttgagaaacctccatactgttttctgtagagattgtgctaatttacattcccaccagcagtgtgtaagtgttcctttttcaatacatccatgccaacatctattgtttgttaactttttaataatggccattctggctaggggaaggtcgtatctcattgtggttttaattggcatttccctaatagttagtgatgttgagcagttttttcacacgtttttggccatttgtatatcttcttttgagaaatatccattcaggtcctttgcccactttttaatgggattatctgttttttcttgctgatttctttgagtttgtagattgcggatattagtactttgtcggatgcataattttcaaatatttacttccattctgtaggttgtctgtttactttgatgattatttattttgctgtgcagaagctttttcattaggtcccatgtatttacttttgcttttgttgcgtttgcttttggggtcctagacataattctttgcccaggccaatgtccaaaagagtttttcctagggattcttctagaatttttatggtttcaggttttatatttaagtctttaatccaccttgagttaatttttgtatctggtgagagataggaatccagtttcgctcttatatatgtggctatttgattttcccagcaccgtttattgaataagttgtattctccttaaattgtgtgtctaatccattatgtttttatatgctttgtcaaagatcagtcagttgtaagtatttggctttatttctgagttctccatcatgttccatttgtctatgcatctacttttatatcattacaatggtgttttaattactatagccttgtagtatcatttgaagttgggtaatgtgattctaagaataaatctttttgcttcggatttctttggctattctagctcttttttggttccctatgaattttatgtttttttttttattttgtgaaaaacgatgttggtattttgataggaattgcattgaatctgtagattactgagcagtatggtcatttccacaataccgattctttcaatctatgaacatgggatgtttttccatttgtttgtcatctatgatttctttcagcagtgttttgtagttctcctttagagatcttttcacctccttggtagagtatatttattaagtgttttaaaaataaagtgttttattttctttgtagctattaaaggggttgagttcttttttttttcttttttttttgagacggaattttgctctgtcccccacactggagtgaatgaagtggtacgatttcggctcactgcaacctctgccacctggttcaggcggttctcctgcctcagcttcccgagtagctgggattatagatgcctgtcactacacctggctaatttttatattttttttcagtataaatggggtttcaccatgttggccaagctggtctcaaactcctgacctcagttgatctgcctgccttggcctcccaaagtcaggcgtgagccaccatgcccagcctgagatcgtgtttgattctcagcttggtcattgttggtatatagcagtgctactgatttgtgtatattgatattgtaacctaagactttactgaattcatttatcagatgtatgagtcttttggaggagtctttagggttttctaacagaggtagttttacttccttttttcctatttggaggcccttgatttctttctctttcctgatttctctggctaggactgccagtattatgatgaatggaagtggggaaagtgggcatcgttgtcttgcttcagttgaatgctttcagcttttccccattcaattcagtatgatgtgggctctgggtttgttatatatggcttttcttattttgaggtatgttccttctgtgcctagtgtgttgagagtttttatcataaagggatattagattttatcaaatgttttttctgcctctattgagatgatcatatggtttttgtttttaattatgtttatgtgatgaatcacattttttgacttgcgtatgtggagccatccctgcatctttagaattatcatggtgaattatttttttgatgtgctattggattcgatttgctattggatttggtttgctagtattgtgttgagaatttttgcatctgtattcatcaggaatattggtctgtagttttcctattttgttatgtcctctcctggctttggtatgaggatactggcttcatagaataagttaggcaggattccctccttctctgtcttttggaataatttcagaaggattggtaccaattcttttttgaatgtctggtagaatttaggtgtgaatccaactggccctgggctttgttttgttggcattttttttttattgctgattcaatatcactgcttgttattagtctcatcaggatttctatttattcctgatttaagctatggggttgtatgtttccaggaacttatttatttcctctagattttctagtttgtgtccagagtggtgttcatagtagtctcaaatgatcttttgcatttctgtggtgtcagttgtgatgtctccattttcatttccaattgaacttatctgaatcttctttcttttcttggttaatctagctagtggtctatcaattttatttatcttttcaaataacctccttgttgtttcattgatcttttataatttttttgtttcaatttgatttagttctgctctgatctttgttatttcttttcttctgctagctttgggtttggtttgttcttgtttcattccttgaaatgtgatgttaggttgtcaacttctgatctttcagacttttaatgtaggcatttagtgctgtaaactttcctcttagcaatgcttttgctgtatcccagagattttgataacttgtgtcacagttatcattcattttgaaaaaaaatttaaatttccatcttgatttgatggttaaccccaaaatcattcagaggtagattgcttaattttcatgtatttgtatagttttgagggttccttttggaattgatttctggttttattccactgtggtctgagaagatacttgatatgattgaaattttctttgctctgctcacacgtttattcatccaggtaaacctaaacatgattttgtctatttcaaaaataaccattaagtaattatttatagaataatttaatgtgagggacccacctttttaccatattgagtcattatatccagaaatgaaacttctctttattgtctttagttttctggtagattccttaacgaagaggcacagttgtctccattttggacttagacatattttattaatttttaccaaagaattttgaattttgtatggcattttaaaaaggtatcttggctttctcttttatttgtatagcctaagcacacatccttattaatttaatactattggactcttaattatgtttgaatatttttgcaaaattaacagcctcatggtgagatggccaatggcaagaaagctccaaggtgcatgcacattagtttcaacaggagctgcctgattcttttcattgattcaagaaacatttgctgagttcttaccatgtgccaagcacggtattaggcacagtcagccaagcctctgagctgggattcccaaactgctgtccttgtacctcatttctatcactgccctccagccaaagcccatcagtcacatacttgtagggtaccaagttgagtttattcttgtcatgagctaaagcatacaacatggaaacaatgagatgccttcataagagggtgttgggaaggacgtattataaacttgggcttgtgttaggtgatttgggggaaggttcaagtaagtaggacctaactctggagtgacgctgccagaaagtgggagtaattctatgattgggtattgtcttgatttgttttctgttgctataattattacttgagactgggtactttataaagaaaataggcttatttcttacagttctggaggcggggcaagttcaaggtgaagaggctgcacctgtaagggccttaatgctggtgaggactctctgcagaggctttttgctgcataaagcatgacatggtgaggaagctgacctcatctaaatctaattatctcctaaatatcctgcctctcaaataccgtggttagatttcccaccctcttttgggaggtgggcttaaacaacagaaacttatttctcacagttatcgaggctgaaaagtccaggatcaagattctagcaaggtaagttttattctgaggtctcttttcttggcttgtgggtggctgccatctcactgtgcactcacattacttctttatgtacacatggacagaaagaaagaaagaaagcgagagggagagagagagggagggagggaaagagagagagagagaacactcaagttaactctcaggtgccttttcttaaaaggatattgatctaatcagactagaccttctcatgacttcatctcactctaattacctctcaaaagtaattacctccctgtctccagataccattacattggttagggcttcaacatatgaattttggagaggtactaccattaaatccataacattaaatttctatttgtcagggttctccagagtaacaaagccaataagacatatagagagatagtgctatttattagcatacatatttatatctctttatattggtatatatgtatatacttatataagaatgtgtgtgtgtgtgtgtgtgtgtgtgtgtgtgtgtagagagagagagagaataagtttattataaggaattggcccacatgattatggatgctaagaagtcccaggaaagccaatgtgtaattccaatctgaaagccatcaagctctagacccaaggagagccaatgtttcactcgaagtccaaagacaagaaaagaccaaggtcccagctcagccatcaggcaggcagagtttcttcatactcaatctttttgttcttttcaggtcttaaatggatgggatgaggcccatgcacactagaaaaggcaatctgtttgactcagcctaccaattcggctttaatcttgcccagaaacaccctcacagatacatatagaatcatgtttgaccaaatatgtgggcaagatttctcacccccttagcacagttatataattgtggttaagtttcactgtgagtttcagaggggacaaacattcaaaccatagcagatatttaataaatcttgttcataagatgagagaaatgaagccaggctaatgctgttatgggtaaagaagcagtggtcagtcacgttagacaaaagaacagatgtttggtcattgttgtggtttctttgaacaatgctcatgctattgtctatgttcaaacatgataacggaggggtcttcttttgtcttgatccatctcggtcacagagctgttttgtctgatgttagtgttttgtgaaattgtttatcttcaataacagaacaccaaggcccaggtgggagttcccagccagctcctggatgtcgggggcttttttccaatctctagtttcattattatcatgtaatcatttttaatatcattcatcttgaaaaggatgcagaagacaatacatagttttgtttagacttaattaagaagagaagctacacataagtgctttcatcaagggccactagaccagtcttattgcaaactcagctgaaacaagctcctgacctgcaatgggccttgtgaatgggtacatggaaataagctgatggacaggcaaggcttggagatgtttctctgatgatttattctttgtagaatgcaagtgcctggttgtgatgctcacttttctcttgaggactcccaggtgtgaccctctgcagggaccatcctcactcctcatgttaggacatatccaaagacaacagctacggagcagagtcactgatgcacatttgtaaagcaatggcaggtcatggcaagtgtccatgctacagggcagtgacccaccatctgctctttgcagttcagctgtggctgaggcaggaaggcagagacagggctggaggtggtagacttttgaatatactgttttcccacctatttatttcaatttccacacccttaagccaattgattccagaacctcaagttagatgtccactttttgtggctatccgtttggctactgattgtaagacacattacagaggtgtacagtccatgtatacacaggcaagtaaggatcttctcattccaaagatgcttgagcagaaaagagcacctgattttcagctcattctgaacactggaactgtgactttaatcatcagtatgttgtataataaaacctgaaggactacacaggataagcattgttagttaagaatggctgactcggctgggcgcggtggctcacgcctgtaatcccagcactttgggaggccgaggcgggcggatcacaaggtcaggagattgagaccatcctggctaacacagtgaaatcccgtctctactaaaaatacaaaaaactagtactcttgtaactgtacaagagtacaccgaacaaaggagacagggtcatttataacaggtgtggtggcgggcacctgtagtcccagctactcgggaggctgaggcaggagaatagcgtgaacctgggaggcagagcttacagtgagccgagacttcgccactgcactccagcctgggcgacagagcgagactccatctcaaaaaaaaaaaaaaaaaaaaaaaaaaaaaagaatggctgactcaaaactttcattctctctaagaactattcagtaaccagtattcaactgattccagttgtagccttctttctaaggaaatggaggtaacttttaacttctgggcccagatgcatcgcctctttacaggtgtggcctaattctcatctctggttggtgctgtgggatctgctccatactgggaagtccctgtctagcttcttgccccttattacttagcttctgtatttgctcagagtggagtctttattcttaatgagaaggagggaagccatatgcattccagggagatggtataaccagagaaaaggccctatggcaagaggaagcttggtgtgtttcctccatgacactgctggggtaaaaaaaaaaaaagagttcattaaagaggagatcagatccttcgagggaggtgagaactttgcattgcactctggatggatggccaggctcttcatttttcctttttcctagtaggcatattcatatgtgtaagcgttttctcttttaagaaaatgaaatcacagagtatatgttagtatgcatttgctttttaagttgacaatatatcacagttgtctttccagacgttagaaatacttgttcctcagtgccataaagaaatagcacttcaacataaatttaatctcctcagcagtgccatttttactttctgcagaaggggtacacccgccagcagttttgccccaagagtacaccaaacaaaggagacagggtcgtttataacctgaggtgtccactctactgctgtgtctggtttccattggctggaacgggacctcacattctgtgtttgtctcgattggctagcaacttagaactttttaaaagaggtaaagagagaggagaacaaaagaaggaggaagtaacttgtggaatgctgagaaaggtagaaacaccttcaaataaggaagaggaacaggctatgacctaatgcttgtttggaccagtataagcatgccagggcagatatttaagctaaattgtgggagctaagaacataaagtaccttgatttcttcattgcggctagcagacatttaagaatgttagcacaggtctttgaataaatttcgcttctaagagaagttactgtttattcctatttagatggggaggaaagtctttgaagaggaacctctactttactttttacacagataaatacacatagctccattttattgtatttcaggagtagctcatatttcactttatggtttggcatcattttgcaactgttatcttagttggacattcagcttggaaacaatttcatgtgttcctgtcatttgagaataacatttctaggccttggaagtagtaggttctcaaccagtgtttgcagcaggaagaaatgcaagagggaaagagcaggagagctgatgccagacatagaagaagatctccaggaagaagttttggaagacatgcttttaggttttcatcgcttctcctttttgtatatggtactgctgaatgctgctaggaacaatactttctccccggagatgcaggtcagatgccatgttttctgtggctcatttagattgatacagaatgggccattgctagaaaatggaaacaaaacagtcagaaagcacttcacaattctgagtctgtagccattgattgtaaatgtgcaagaggagaaaagagcacttttgcttaaaaccccattgataatgcagcaaggggaaggtacattgctctgtgaaaagaataaggagaaaggggctttctgtagccataaactgcattaacaggcacataataccatgagtgttgtcattgtcatcacaccatggagccacctctgtgctaccttggccatgtattgaagccaggagaaaaaaacaagggtaagtgcatgagcattaaaaaaattaacgtttggaagtcctgagttgtcttttattttctgcgacctctgagaagcccctctttctcatgtgccactgtaaaattatttccacaactgtaaaaattgggattgtagtaatgctaaatgaatccattctgctcattcagtcctgtctcccaaggtaatcactgtaaaaggctaaggatgatgcattatgagagaatagcatagccatgtggagaggcagtgccagggagtgcgtttgccattgtgtgtgtgtgtgtgtgtgtgtgtgtgttcagcaaatacagccagccctttgaatctgcagcttccacactcatagattcaaccatcctcaaataaaaaatattcagggaaaaaaaaacaaaaaaatacaacaataaacataaatacaaatataacacagtacaatacaacaactatttggatagcacttgtattttattaggtttcatatgtagtctagatggcacctaaagtgtgcaggaggatgtgtgtaggttagctgcaaatactaggccagtgcatatgaaaagtcttgaactctctcagagttttgtatcctgtatgaggggttcctggaaccaattccccaaagataccaagaaacaattgtatctttgttttctttcctctcttatcccattatcatataacatatgatacattgatttgctatcatagtatttaagtattgtcaacttcacatcatagtagtaaagttacgggacattaaggagaggcatgaacatcaccaaaggactttgcttttcttttagggacagggtttgtgtgctttcagttgtgctcagggtagtgatattatgtgaagtggaagtataaccttgttattgtctttatttgaagagtaagtatggtgtaagcagacgtgcatggatgccgagttgacaaggtgtggatttgtgatggttaattgtatgtgtcacttttgctaggcatggtactcagatgcttggtcaaaagccagcctagatgtcgctgtgaaggtatttcttagatgtgattaacatttaaatccatagatttttgagtaaagtagattatccttcataatgcgggtgggcttcatcaattaaaggtccttagaaaaacagactgaagtccctggaagaaagaggagatgctgcctccttcggacccaagctgcacatcagttctttcctgggtacagcctgctggctggcccggcaaattttagacttactagcccacacaatttcatggagtggttccttatcataaatctctctgtctctttgtgtgtgtgtgtctgtctgtgtgtgtctctctctctctctgtctctctctctctctctctgtctgtctctctctctcctattggttctgtttctctgggaagccctgactaatgcagattttgatattagtggcctaaaagttcaggaaggattatattcccacacacatgccttgtagcacccacagcctaaatacctaaatacctccctcagcaaaatgacacatattaacgtgtgcatattttaacatgccgtgaacttccatgctgtttacaaaaagttgaaactgcaaattcactctgtaaatgcttcagggtatgctgcattttaatttgggaatacagagttttaaagactcaagtccaaaacatacattggataccttctgtattagttttctcaagttgccattacaaactaccacaaacttagtgacttaaggaaaatacccttttattatccagagttttgcaggttgggcatccagtggcttggctggtttctctgcttcacatatcacaaagccaaagtcagagcgtccgcagcactgtgctcctcttactggaggacctgggagagaattttcttcctggctctttctgactgtgggcagaattctgctccaggtggctgtgagacagacatcgctgcttccctgccagctgtcagctaggggttgtcctgagctcctataagcctcattctattccttgcatataatcacttacatctcagaattagccaagtgtggggtgagtccttctgacacttcagatctctgactctccttctgttctgtttcttttgcttctgtttctgccacaaggcatggactgactcctctgctttcttattctgcatttaaagtcccatgcgatgtctctggacccacccagagaatttaggatcttctccctattttaagatcagttaattagcaaccttcattccatcagcagaatacctttcactgtgtacagtaacatatttatgttccctagattaggccggggaggtctttgaagcaccattattctgcctactgtattgctatgagcaaggactgtaaatgtcctcgcctttaagtcttttatagactcactggggaaaagagccacatacatgtagtagatcatttgtaacattatctcaaaccataacatggggttgcagagcggaacccggcttcatgaatcacaccacaaaaacggagcgggagctgtctgagtcaccactctctggcacagaacacccagcacacagtaacatacacagcaggtactcaatggttaaagggatgaatggatatagaggaaaactgagtaggagacttaaaaaatggagtcgtctcctcaatgggatttaacatcctttatttacctgtttattccataattatatattggaagtctaatctatacaactgccagtgctgggccttagagatgcaattgtgattagaccagggggcctttacccacacggagcttataatttgacattaatcatatcagcagatgaataatctcacagttaaaacatgcaccaaatataatgaaggcacttactagatggcacgtgagagataagggaaagccactctgaggacgctgatttttgagtggaaagctggataaaggaggattgtcttaggctggcttctggcagggatctgtgtgctggaaacctgctggaaagcgcttgggatcaacgccatagggggagtacaggaagttggagaggcacagaaagaagctgggatgcagatgcaagcagggcccagctgatcctgcaaagagctctgaagctgggtggcccttccaaggtggctggggctgggggcctgggctttatacccacccccgtgaaccagtcaccttgattctgtgtgttaagtcataatgtacctcagttttctggaggtgagacctctgttttcaatggttggaaaagctcatgactataagcatcagatgcattcgtattgccaactgtatcattttgtatgcgtcagaaaatcctttcttgcttagaggaatgggggagcataatgaatcagtttaaatttgctcccatcaccaccttccaccgggttctgagcttttacttatttccttatatcatcatagccagtccaacttaaactgtgatattccaccctccccctgcctggagtgtttggtcttttcattcagggtaacttgcctctattgtaatggggtgatatgatatgaggagatcatgcaaaacaaaggctctgtcatttatcttagctgtgactatttatctaatatttactgaccatcaaagccctcactctgtatggaaaacagccttcaatattgtctgacaccaactgggtatcctacaatttagtttgattcaggcactaattacctggagttcgtatcagatcccatgagttaaagggcaagatccctaacaagactgctcttatgtcagacaccagcagtgagtggggtcccaggcttcccacacttctgcctggatagctgcaaattcaagatagcacaccctccttgggtttgataatctgctagaacctcttacagcattcaggaaaatgccatacttaacaattaccattttaccaaaaaggacatgagtgaacagccagatgcacaggtacatgtggcaagatccggaagggtcctgagcacaggagcttccagccttgtggatctgggttgtgccgccctccgggcgtacccatatattcaccaaccaggaagctgtctgagttgcattgctcagagtttttatctaagttttattacggaggcgtgattgattaaatcattggccacatgactgagatctatttctagcccctcttccttccccagaggtcagggggtgaggctgaatgtccccctcctctcatcacatggttggtctttccagaaggccagcccctccttgataatcatctgagggcccaccataagtcacctcattagcataaactcaggtactgcagaagtagaaagggtctgttgtgagtaactgaagacatttctatcactctgaaaactccaagaggttttgaagctctgtcccggaaccaggaacaaagaccagatatattctgcattgtatcatgtaatcaaatacatgcaatttatttggcagggaatttccaggctccctgctatacagtccctaacagagttaggagaatgataaagaggtaaataacatcctccctcccacgatgctccccaatgccttgcagagacttgtgctacagaattccctcactgtggaccaaccatcctaagcccagatagtttctgtagtgtccatggaaacttaggcatcatcgtcctgtgctcacacttcacctgtcttctccctcctggtttatgtcttcctgctcaggtatgtgtaaggcagataaacatgtcacttcccaattaaatagcaaacagaagaatataaattccatttacccactttacaggcactcccaacctctgtgagtgatacgttctcagccccccgccccttacttgggtctagggggacagacaactcgagccttagcactctctagtaacccaggacaattttctctttctccccacttcccccaattttgttttatacgttgggaagttgtggggactggagtaatgattgagagtagcagaacttaagcctttaatgggaatctggttcccatagtcttgaaaaaagtttaaggatgtgatactttgatcctcaatcttgaatcatagaaacaaagtctagggcaatagtaaaaagtccctatcaaaactcacttgcatgtacctggccacccggctggcccttcttagtattttttttctgattataacaattacacaggttcccatatattttaaaaataaaataatagattgaaaggtagaaaaatctctccttatcccaacactcaaaagatggtgatagaaatatttctctttttcctactcaagatctgaaatttatgagggaaacaaaggaggaaaacaacaaaatctcatttgtcaaagataaaattcatgtgagacaatgctgtttatatctatgggcagatactcctcataacttaagctaagaatccagtaggcttacccagacagtcctaggcatcacaggaccccaataccacctctgtaccctaccaaagattagggccacccatgcatactttatggcataaaggtctgattttattatctatgtctttgtaactaattatcacagattttgcagcttaaaatggcatacacttatgttcttacagtttttgtgggtccaggagtccagacatagcttactgaggtcctggcttcaaccatctgaaacaaacagctttctcaatgtcttcctcaaggctgcaatcaaagtagtagccatggcttaggtctcatctgaaggctcaagtggggatctgcttccaagttcatgtaattgttgtcaggagtcaacttgtggcctcacttactctttggctgttggccaagtaaaggtcacccttggtaccttgccatgaggatgtctgcaacatggctgcttgcttgcaagtgtcgtttgtttgttttgttttgttttaaaaaaaagaaagaaaagaaaacatgcaagtggagaaggcaacagagagagttgaaagatggaagttataatatcatgtgagcttatcaaggaaatgatgtcccactatctttgccatatttaagtgattagaagaaagtcacaggacctacctacactcaagaataggagattccacaagggcatgaatatcaggggacaggatcactgggggctatcttggaatctgcccactacagggtgtttcttaggaactgtcagctcccaacaaaaagtacaggaaagggtagagctgtatatgcctagttcccacttccaaactcattatcaagtgtaagtcattccttctatcccaaattaaaacaagggaagactaggaaataggagaagtgttacctcaacaggtctgatctacgtagaaggaaacatcgggaatggtgagaaaaaccctccctcacaaaaaaaaattaatatagtgataaatctccttgtggcctatttttttttctctctgctaatatgtgctgaagcatttttctgtaactagaaacatctgaatgtactgtttaataacttagcctttattctgatctatatgtgttgatttttttctgtgttactcagtattcttctgctatgtgccttttagtggtctgcactctctatcacatggccagcccagtaactgtgtagccagccctcgatggcccatttgactctggtcccttacagcctccaagctgcatcagcagcatagctccctccaccatatttcattgatgacagaagagaaggcaggcagcatgctgcagcacaagggctgtgggagcccagaagtctgcaaaaaggcctccactcccttttcaggatatcaggtgatagagattgagcaaatgctctgtggtgttatcagtgcccagaactggtctgataagcagggaaagacgccaagaaggacagggtcttggagatgcaggtaacatgtgcacccagcccagccatcacccttttcccattcaaatcttgaacttgccaaggtagccctttattgaagagtgcttaattacttccggccacctccatgaacatgaacatgtcagtaatctttcaagtcttctcattagcagtgaggttgggaacgtcagccccgacccagtgcagcacagcagccctcactgagctgtcgctgccacttcaggaaagtgtcttaatgtgagggctgccttttcacagattagtgacggggatgaaaggaggcaacagtgaagccatctggggattcagacattctgggttaattctttgtgagaaaatgtaaaatggccacattttgcactgtattagcaggccatctatcacaactgtttaagtgtggaattttttaaaaaattatgaaagaaccacagaagatgcatcaagctaaattgaaatttttatctgcagcttaccacatagtgtcatatatacactcttactttatgtcttcctgtcttgatacaaccttaaaggaagtagccttcatctccctttattcatatttctaattgaggcccttgacttttttaaaaaacaccaaaattccttaccatgtagaagtttttcagagatgtcgcagaccacatgaagagtgttggggtccccagatgctgcatgaattaagcttgcgacagaggctgtgaatccccaaaccgtcataggtcattctactggcctgaaccctgcaattgccaaacccaggcaaggatacgacattgtctcatgtttaaattccaaggtcatggagtcaaggtcaatgtgagtagaacctgcaaaaacagtacaaagtgaccatgttctcaaggttaaaagtcaagagaaggacctcagcttcctttgaaatggctccacccaggtctcagatgtgtgtcagcttagggtttccttccacttggaatagtgccaggaggccttgatctcagacaaaataccttgaggcctcttccttattaggggctggggctacacacctaactccttcatccttctttggagcttggaggttgttctcttctcttctggctgcaaggaacccctgcattttccccatgaagccatgattacctcaactctgtgtttcctaaagcttaactcccagcataccaggttgcaaagagagctcacttctgaccctgagacctgccacatcacacactccagagagacagctgccttcatgaacaactttctcaaacctgctgaaatgttgctttcatactcgtgtttgttcacccttcacaattcccatgatttgaatatatttctacgctaatgtatcgttttgttttcatgctgctaataaagacatacccgagactgggaagaaaaaaagtttagttggacttatagttccacgtggctgtggaggcctcagaatcatggtgggaggcaaaaggcacttcttacatggcagcggcaagagaaaatgagaaggatgcaaaagcagaaacctctgataaaaccatcagatctcatgagacttatccactaccatgagaacagtatcggggaaactacccctatgattcagattatctcttacctggtccctcccacaacacatgggaattatgggagtacaattcaagatgagatttgggtgggaacacagagccaaaccatatcagctaatatccaacaatactgcaatttgcataactatctgccctgcttcagatgacaaaactgatgttcattggtatgatttggctgtgcccccatccaaatctctactagaattgtatctcctagaatttccatgtgctgtgggagggacccagtgggagataattgaatcatgggggtcagtctttcctgtgctattcgtgtgatggtgaataagtctcatgagatctgatgggtttatcaggggtttctgcttttacttcatcttcatttttctcttgccgccaccatgtaagaagtggctttcgcctcctgccgtgattctgaggcctcctcagccatgtggaactgtaagtccaatccaacctctttttcttcccagtctcaggtatgtcttcatcagcagtgtggaaacagactaatacagtaaattggtacctgtagagtggggcactgctgaaaagatacctgaaaatatggaagcaactttggaactgggtaaccggcagaggttggaacagtttggagggctcagaagaatacagaaaaatgtgggaaagtttggaacttcctagagacttgaatggctttgcccaaaatgctgatagtgatatggacaataacgtcaggctgaggtggtctcagatggaaatgaggaacttgttgggaactggagcaaaggtgacacttataatattttagcaaagagactggcagcattttgcccctgtcctagagatttgtggaactttgaacttgagaaagatggtttagggtatctggtggaagaaatttctaagcagcaaagcattcaaaagatgacttgggtgctgttaaaggcatttcattttataagggaagcagagcataaaagtttggaaaatttgcagcctgacaatgtgatagaaaagaaaatgccatcttctgaggagaaatttgcataagtaacaaggagccaaatgttaattcccaggataatggggaaaatgtctccagggcatgtcagaggtcttcatagcagccgttcttatcacagacctggaggcataggaggaaaaaatggtttcatgggccaacaccagggtgcccatgctgtgtgcagcctagggagttggtgccctgcatcccagccactccagccatgactaaaaggggcgaagggacagctcaggccatggcttcagagggtgcaagccccaagccttggcagcttccatgtggtgttgagcctgtgggtgcacagaagtcaagaattgaggtttgggaatgtcctcctaggtttcaggagatgtatggaaatgcctggatgcccaggcaaaagttcgctgcaggggcatggtcctcatggagaatctctgctagggcagtgtcaaagggaaatgtggggtcagaggccccacacagagtccctactggggcaccacctagtggaactgtgagaagagggctactgtcctccagaccccagaatggtagatccactgacagtttgcatcatgtgcctacaaaagtcacagacattcaacaccagcccatgaaagcagctggaatgaaggttgtaccctggaaagcctcaggggtggaactgcccaagaccatgggaatgcatctgttgcatcagcatgacctggatgcaagacatggagtcaaaggagatcattttggaactttaagatttgactgccctgctggattgtgggctttcatggggcctgtagcccctttgttttggctaatttctcccatttggaatggctatatttccccaatgcctgtacccccattgtatctaggaagtagctaggctttgattgcacaggctcataggcagaagggacttgccttgtctcagatgagactttggactgtgaactttgggttaatactgaaatgagttaagactttgggggactgttgggaaggcatgattgtttttgaaatgtgaggacatgagattttggaggggccaagggtagaatgatatggtttggctgtgcccccccaccaaatctcaacttgaattgtatctcccagaattcccatgtgttgtgggagggtcttagctggaggtaattaaatcatgggggtcagcgtttcacatgctattctcatgatagtgaatacatctcacaatatctgatgggtttatcagggatttgcgcttttgcttcctcttcatttttctcttgctgccaccatgtaagaagtgcctttccctgcgccccatgatgctgagacctccccagccatatggagctataaatccaattcaacctctttttcttcccagcctcaggtatgtctttatcagcagtgtgaaaatggactaatacattcatcaaggttaaagattgacccaaggccacatataggtgaccagctgtctcagtttccctgggactctctcagtctccacattgaaagtcctgcatcctggggactcctcacacagcaggaaattaaaaagctgagatttaaacttgggccctctccaggctatccactgtgggcttctgcctgatttctagcactgttctttacagtagtatggacttcaccttcattgctgttggatacttcttcaccgtgttagtcatgagtagtgcacatctacccaccccaagatcctgctctcctggggcctctttttttttttctttgatatagagtctctctctgttgcccaggctggagtgcagtggcgagatctcagctcagtgcagcctccacctcccaggttccaacagttctcctgcctcagcctcttgagtagctgagactacaggcatgcaccaccacacctagctaatttttttttttttttttttttttttttttttttttttagtacggactgggtttcatcatgttggccaggctggtcttgaacttttgacctcatttgattcacctgccttggcttcccaaagtgctgggattacaggtgtgagccaccatgccagagcctcttttctgcttctttctggacgtataggaagtgagtatgggattcttgcccatgttcactcaggctctctgaacaggcttcttgaggatgttttttaaaatctcctttggcttttatttgagagtctagattcaggcaacacctcatttgatgccatagaatgagtgttcccatgagctgagcagaggaggtggggtttatagagagaaaaggcctgaggaaagcagatacagagaacaaaaatctgatgggtagtttaaaagtgactgtccttaaagggctaaaacagaagggacttccctatcctgccagcttaggtaagcttggccccttctgatccattgctgtggagctcctagtttttaaggaacaggaacctggatcttatcagcaatctaccatccccgttcctcctcctggctagataagtatgaaagcgtcattgatttgtccagtttcagaataatgaaaagcacaaaagcccatggcagaccagaggtgtaatgtccatggctcagggaggctcacacacaatctcttcctcatttgttaattcctggcataaaggaaaaagagagactatgagctccacccacctaagcgagcctccctgccagcaccaaccctgaaagggtgaaaagcagagattcatgtcatcaaaacacttgcaaaattcccctgacttgctgcttgataggcctcccttcagggagaggtgcaggtggaggcatcttcagaagccatcccagccccgggaacctcatgcgaaatcacccagcaagctatgatggactgggctaccctctcagctttccttttttctcatgtgtcagagaggagctagggtaaatcctgaaaacatgaaacagttcccagacacgaggacttgcccttgttaggataacaggcccctttttgtcctaaagaggtcctcccactcagagggatgagcaaactcagggctgctggctgcctctccagaccaaatgcacagctttgatttaaggacttgcaccttaatcacccatcatgtgtcattaccccaacaggcggcagcagccgtaagacacaagtgccaataaattgtgctgaaagttactggagtgattctttgtttattttctctcacagctattctgtgacacttgggctggcattggaacaacatggttgccacatgtaaggaaggggttcaaggtgactgggggaagcaggagcatccctccctccctccctcgattttcttcctgtagattcccagtgcctcgctcagctctctaggaagtcaagcccttggcagtcggcggaaatgagcactgtctcattagctaattgccagtacagattttcaagtacttctgcatgcaaatcataacagcactgagctttcttgctttttaaaactcctctttcacccatcccaccccctggcttctggaggaaaatgaggtctgttacaaactgcacatcagattacttctggggcttttctggctcacgtttcccaccctcgccgccccaacctgagcagagctcctaactacctacctaccactgctgtgagggaccatgaagcagaaggtgctacttagctttggtccagaacaccttcagcagctttcctcgtgcgccccatcccttcaggattcatctcagacctcttagatctgcatcacagaaaacaaaatgcaaaccaggcacagggacttaagaaaatgattgattaaatggagagtagtctactgctgcacaattgtgactttttttttttttttttttccggagacggagtctcattctgtcacccaggctggagtgcagtggcacaatctgggctcactgaaacctccttctcctgggttcaagcgattctcctgcctcagcctcccaagtagttgggattataggtgtccaccaccatgcccagctaatttttgtatttttagtagagatggggtttctccatgttggccagtctggtctcgaactcctgacctcaagtgatccacccgccttggcctcccaaagtgttgggattacaggcgtgaaccactcttcccggtcacaattgtgaattttaataacagtttggctccaatcagtatgataaaagtcataagatattagttcaccgtgacagaatggtccatttccacatggcagtagaccagtttaaaaatggtctcctccttgtgttgtctaaatggggaaggaacaacccatttgggcatcaaggtgcatttattttccacttgtctttagctgtgctttctggggttgacaggactgaaatgaacatcacagatgggaaatgaccccgtcaccgtcagaggtccctccctctgatgcctgtgtggatcactgccccggtagaccgtctccatgacactgggggaaattaatgtgatgacaagcaatggtggctgctggcaagggtgttccattcctctttctttgcattatccttttctcctccagaaatgctcaccgaattcagcaatcacacctgggcattctctgaagtcatggaatacagtgctgaaacaatgtgtggaggagcaaaaaatctaggattttagaaggctgccatgtcacaggcagggctggctttatgggggagcaaacggtgcagtcacacagggccccacactcagaaaaaaccgatgcttttatttatttactgctgtcatcatcttgcaaatcttagtttttgaatgagaagcttcacatttccattttgcactgattatgtctcctgtacaggtaatatgtgtgaaaatattcttgttaaaagtgctcatttctttccttttttcactacctttcactattgaaaaagaaaaagaaatgcatttaagaagacagtctgtgcttttttaccaaagcaaaacaatccaatcaaggaaatgctcaatccatcccctcccacaaagactgaaattttatttttaaaaaaatcactttattatttttttcctttttctttatgattgtacatctgctttaattctaaattgcaaaatgtaacaggagtattgcagggagacctcttctcctgagctttcatgttccaaagtcagtctaaatacatgagaacattcactgtaacagaatcccaggggtggtcccaaagcacagaccagatcactcagctgtgaggtgggagactcagatatcattagctgtaaatagaaaacaggaagcaaagccccagacacaggggagtcttatgttactagaataaaatgggtaataaggggtcaccttcaaggacagaagttgttgagagaaggacctggtcgtggctggaagagctgtacgtgaggtggaaatgagtggtgggaaacagatccagaaaagtcctgtgccagtgaggatagagggttctgctcagtacgcagcaacctgcttcttagctgcttaaacaaagagttgtttatcactcacacaatatgcccactgtggggttgggggcagggggatctgcttattgtgggctcaggatcccagactgacaaaacaagcaccatttcaaagttgcatgtcacagtgtcaataagagtggcctggatggtgccatcataacaaggcttccagcctggaagccacacatggcacttctgctcacaactcattcactgaaggctacacatggtgcttatgctcacagcttatttgctggaagctcatgtagtacttctgctcacagctcattggctggaagacacacatggtaccacatggtacttctgctcacatttcctgggtcagaagacacatatggcacttctgctgacagctcattggttggaagatacacatggcacttctactcacagctcattggctaaagccagtcatatggccccatccaaccacaagggaccaggcagaacaagtttcccaggtgctcagaaggtagatgagcggaaacatgtgacagacagcactcacgatcaccacagagcctaaaacattactttatttacttgattattttgaccgttcatccatttgttcattcattccttcaggagtccatctaacaaagtcattttctttcttttaaaaaaaaaaaaaaaacttttaggttcaggggtacacatgcaggtttcttccataggtaaacacatatcactggggtttgttgtacagattattttatcacccaggtattaagctcagtacccaatggttgtcttttctgctcctttccctcctcccaccctccccactcaagtagaacccagtgtctgttgtttccttctttgtgtttataagttctcatcatttagctcccacttataagtgataacatgtggcatgtggttttctgttcttgcattagtttgctaaagataatggccttcaactccatcgatgtccctacaaaagacgtgatctcattcttttttatggccgcatggtattccatggtgtatatatacggcagtttctttattcaatctgtcattgatgggcatttaggtggattccacatcttttctattcttaatagtgcttcagtgaacatttgcttgcatgtgtctttatggtagaatgatttatattcctctggatacatacccagtaatgggattgctgggttgaatggtagttctgctttttagctttttgaggaatcaccataccatattgctttccacaatgattgaactaatttacactcccaccaacagtgtatgaatgttcagttttctctgcaaccttaccggcacctgttattttttttagactttttaataatagctattctgactggtatgagatggtatatcattgtcgtcttgatttgcatttctctagtgattggtgatattgagcttttttcatatatttgttggctacatgtttgtcttcttttgaaaagcatctgttcatatcctttgcccaatttttaatggggttgtttgtttttcccttgtaaatttgtttacattcctatagatactaaatattagacctttgtcagttgcatagttttcaaatattttctcacattctgtaggttgtctctttactctgttgatagtttcttttgctgtgctgaagctcttcagtttaattagatcctacttgtcaatttttgcttttgttgtgattgcttttagagtctttgtcatgaaatatttgcctgttcctaggtccaggatggtattgcctaggttgtcttccagggcttttacagttttgggttttacatttaaatctttaatccatctggagttgatttttgcgtgtggtgtaaggaaggggtccagtttcaatcttctgcgtacggttagccagttctcccagcaccattaccattagtcattttctgtgggtaagatgtgatagatcttgatagaatcatcaggatctctgcacccaagaagcttagatatggtggggaagctacaaatacctgttacaaggggatcagtggcactcgtcacaaatggcatgcatgcctgtcaggcaatttgttattggaatgtagaggaggaatccaatattttcacacagggcaatcaatggatactgcacaaaggagggggcattggagctatgtagtaaaaactatgcagtttcagtaagcagaggaaaggacgggaatggggaagaaatttctgacattgggaacagcctgaacaaaaacgtgaaggctggaaaatataaggtaatttaggtagaaaaggctcacatgtaattcactgtcatcttgtggaagacacagaatgctattaaaggcagacaaagtgtaatccaagatgtatttgcagaaaagtaatgaatatctatctatctgtatgcaagatacattagaatgggtagagttagaatagaaaaggaggcaaaaaaaaaaaaaaaaaaaaaaaaccagtgaggaagctactgcagtagctagataagaggggatgaaggcctactgaacaaaggtagaatgggaatagaaaggaaaggtggaggtccctgtgggacaggcaggtagatgtggccagccttcacctgcctggcttgaatgttaatcgggagggcttcctcctgtggttgtatagatcggtgctgcccaaagtggggtctggggacccaccgcatctgcattgcagggggcccaggggcagatcttgtgagaaatgcaaattcccctgggttgtaccctggcaatttgtgttccaacaagatctctgggtgttttgtgtgcacatgaaggtctgagcagctatggtagaggcgatgtgcagtgaatctagcctccctatccagtgttcctgccaggacctgatggaagtataactgagatgctcgcctggagaggcccctgcgtatgtaccccctggaatgggcaggtgttagacaagcatggaatacattaaaaagtaaccatcctaaagcattcagggttactgtataaaatatttccagcccggttttctaagtcttttgcatacaacttttgagtgctttgggaactctttctgaggctggattaagtttctactgctgtaacctatgccacttctgagggaagaagccatattgagcctcatctgtccttctaaatcaagtgactttggaagtttcctataaaattctaggcacttatgttcaattactttatcatatcttcccagcatagaaaaacttcctaacccagatgatctcattcaccttatgctggaaaaagcattacattttatttcctctcttataaaattactttctttatctcttgaaaacttagaaggagcctcttctttcatcgttgctttttttgatttcttcttgcacagtaaagtgattaactcaaatttaagaaggcaggtatccaaaaatagcatatacaaaacaggcctacttctctatcttgtgatctaaagcaatgttgttataggttattatttccttttcctaagaaacttgtgatatcaaaattatatttccagcatgtactatcattatttcttctcactttgaaaaaaaaggaaaaactaattttcctgttctttgctagggcccgattcatctttaagtatccgggtatttaaggttttgacatcctgaaacgctgtgcattcttctctgcagaaaagacctttggagcagactttctagagatagggagaaatgatggtaatccatcataatggcctgattccactctggacacataactgttctccatctctgaagccattcctagggaaagtttaaaagatcataagttagacggtgaatgatacacatgatgctcaaattagaatctactttttttcagagtggcattgacgctgcctctcaagcaaagagaagcaggatcatcaccttatatggggacttatatcactgtcagattcagatgagaagggcacagtcattctcacctgaaagtggtaggattctagaaaattacggaaagtcttttaattcctcccgagtactgcactgtcacctctgggagctgtcaccaaaaagaatagttgcatgtcatttaaggccatgtcaagccggtacttagacatggtttaggcatggaaaaggaaagagatgcttctggatggtgttgcttatttaggcaacacacaaattagtcattttcttttcccccagctgctatggcacatgtgagagaagacgcaatgctttccactcagagcgcttggttgtctctgtcttcctccttctgagaggacacctaggccaacatacctgctaggtggagtttagcggtgaacacctctatcccctctcctactcgctgttaggcccagatgtccccaaaagctatccagctctaccacctccctggttttaaaacacagagcctttggctgtggattattgtgtaaagaggagattctcatgagccaaagtctggcccattttcagttcctccacctggagtgccacatcctgagtatgcttgtccaaatatgtccaagggtcgttttcactggagatgagagagctaactaagaatgcagattcccattccactttccagaccacagaatcagacttgggggctggagtcttatatttctattcctggaggcacccagttgattctttggagtattatggtttaaaaaatcctcagattctaccccagggagggccatctttccttcatttcctcccacatatccccatatctgattcaatttttctcccaatcttccacaagctctttggtagacagaaaactatacaccccctccccaggatgtctgtagcccaacccacggaatctgtgaatgtattactttacatgacaaaatgcctttgcagatgtgattaagggaaagatcttgagatggagagatgaccctggattagccaggcaggcccagtgtcatcaccaggatcttcataacagagaggcaagaggccatgaaccaaggaatttaggcagcccttaagagacttggaagacagtgtggctattcctcaaggatctagaaccagaaataccatttgacccagcaatcccattactaggtacatacccaaaggattataagttattctactataaagacacatgcacatgtatgtttattgcagcactgttcacaatagcaaagacttggaaccaacccaaatgcccatcagtaatagacttgataaagaaaatgtggcacatatacaccatggaatactatgcagccataaaaaaggatgagtttatatcctttgcagggacatggatgaagctggaaaccatcattctcagcaaactaacacaagaacagaaaaccaaacaccacgtgttctcactcatcagtgggagctgaacaatgagaacacatggacacagggaggggaacatcacacaccagggcctgtcagagggtgggggcctaggggagggatagcattaggagatatacctaatgtagatgacaggttgatgggtgcagcaaaccaccatggcatgtatatacctatgtaacaaacctgcatgttctccacatgtaccccagaacttaaagtataataataataataaacttctttagtgcctccagaaggaatacagccctgctgacacccttgagttcagacttctcatctccaaaactgtaagagaataaatgtgcattatttcaagagtgagaacttattccagcagccacaggaaatgtctacaacctcctagctttgttgcagtgtttgttcagcaaacctggactgaacagtctccacagaattgttgaagagctagcgctgggatgtgtgatgggcactagacacctacctttcaggagttgacgggagagttggaagacagttgttcagtcattgtcagaagtaataaagctgtccatggcttctcgcactgttctcctcatgtgccttgcctggtgacattggcagcctcctctcagacactagtaagatgaaacatctttgtttcggttatctgagtgtaattaggtagacactgactgcttactgtagatcagtcatggtcccaagctgtttatccatattaactcatttaataattattcctccacaatgatttcagtactattattaacctcattttaaagatgagggaactaatgcctagggctcagttgaccccaggcttctatgaagcagagccaggttgtgagtctgggcagcctgacccctggtgtcactcaaaacccgtcatgtgctctgtgtctgagggctgggtgtttctttcctttgactacagcacctgagatctagctccttaccccatgtatttgtaccctggaagtaacaccctacagaactggaagttctgtacagattttggaaggataaactagcccacatccacggagacccaccagatagagaagagccagaagccctgggctatggtgaccttacaacacggtgagcgtgagccagagctccgatgctcttcagagtgggcactttgagaagcatattttgacttattcattaatcaaatgttgattaagtttcctctttgggccacaccctgggctcagtgcttggcatatcatacaaagcaaggcaacctgctacctatacacagaaagcagtttctagaatgcaggcaagaaacatgggcagctaagttcaaggtttagaattcttctttaatacatgcagctgcatcggcagaaacaagtttatatatttaagtgtgcagatggaagcaagtgtacagaggaaatttatttccaacccacagtgtttccaccctcgatatggtacttgataatacagccacattgtacttcatcacctggggctttggcaacttttgttttagcaaaacaaccttacttttgaataatagaaaaattatccatgcaacagtgagctttttttcttagtcccgttgatgatacaaacatacgtttattgcatctaatgtgacggagctctctcagtaatgatgatggctgttggtgcagtgtaaagggacctgatttttttttttttctgaaaaggaatgcaagcctggtgatgcatcatcattaacttcctagctgcaatgtccttgggagtgaggccaaatttgcttgcagatgaatacagttgaagaagtgtcgaatcaggtgatcctaaggggtggagaagatacattttgaatggaaggcagtgtttggccctcatgggtgtggtgccattttctttcttccgaatggtccttgagaactaaattctgttttccattatttcagctgagctctcttgctgaagggggacagggtgattaaagagctcagaaagagccctacacagaccgaagtagcagctctcttagtcttaattatcggcctttatgtaacattcttcaaattaaacatacagcgaaagaaaataaatgcctccatattttgaaaacctgacagcttcctctcttgtgttttcctacttcataaggcaaaatgtgtttcttgtagaggctagtacagatggttactctggaccatacggttaactgatatgaaaccactgtctgttttgagtctcatctttgtattttatggtcaccatctggccccctgaccatatcccaatgcctcagtagggctgaaggtggataactccattgtaatgtatcactattttcatagaataatataaacatttgctctgctaatttttgtttcttgcatgtagtgtagtagattctttaattacacaggcaaataaattactcctaatactattgcatttctgaagaggctagtttcatacaaacgaggaagagctgatagtgatagtgatttttattaacaaggtctgctatcattgcagacatagggcaactaagtcataatgccctgatatgcttacgaagatctggagctagacggagaccaagaagcctcctgtgacctgcctctaccctgggcttcggggatacatattttactcacattatatttttaggaaaaacaacccaggggaatcattcagggtacatgaagttctatcagcaaaaaaagaaaaaaagaaacatatccacccaaagaattggcaactggatgcatttaaatgtaccaggaaggaatgacagagaccatgtgactgcagaaaagtgagagaagagagaactggatcaagaacatcatagaataggcaaagacagagaggagaagcaggaaacagaatgctgaggctacaatagacaggagttagaatggtcacagaattttcatattccttatttcccaaaagttcaagaaccagccacatcttgactcaacattaccaagtatggaaaagcacgtaatagcttacaatgatcttttcttacaagtgccaggcccagtgggaactgctttgcttatgtaatctcatttatccttgcatcagcctctgaagtggacatgaccatgatttccattttacaggcaaagcaactgtgtggctcagagatgttaaactacttgtccaaagttgcagaactgttctgtaccagagacgagttgacttctgcgctatgtagatcttcacaacttggatggtcttagtagaattactcaaatttaccttgacccaggcaccatgttgtccaaaaagtaattccatgcctcaagagtaaagtgaaaaccaaatcactgttttaagaccgatataatattctgagaatgcagccatgttccgtgctagccagctcttcaggttcactctgtgacaagagctgttgtacattcccagcatgggccttctggttaagaaggactgcaggcatcattagcctgggaactgagatttgcacagactggctgaatgaactgagtcattcaacagccaaagcgaggcaggaaggagtgtgcagaccttacctgaggctgtcagatgttgatacagcctggagccatcttaacatgcaagaactattactgagccatgaaaaagaagtgaattggagtgataccaggtcatgtggaattgctatgagttattgctgcttgggaaagtaaatgccgagttgtgtgtagtagataccgttctgtcaaatgaactataaccaaaaaattgcgtatgtgtgtacatgcgtgtgtatgattgcagagaaaaatatgaaagggcatacaccaggttattaataaagactagagggcagggatgagcatgagggagtgtgtccatgtggaggagaaggacagaaaggtggacataggggcaaaaagtctctaattatatcaacagcatacgtaatgtgtttccacttgtgcaatattacgtgttgtgtgtgtgtgtatcatacataagaacatattgaagcatggtcagtagaaatttgaccaaaattgcctcagactggttggttgaatttttagtgacctttattttcttcatcagatttaagtatatttgtttaggtgagttttttggagcctgcagatgcttttgagtgaagaaaaaaatatatttaaaatattacttggactttaatatggtcatttattaaagttataaatgtaaaaaccctctttttcagttcaacttataaattttgttattctatgtatgtatctcgtaaatttaaacaagtactcttaagggattttaaaaaaaacttttaggttcgggagtacatgtgcaggtttgttatacaggtaaactgtcgtcacgggggtttggtgtacagattacttcatcacccagataataagcataatacccaataggtgttttttctgatcctctccgttatctcacgtgaagagatttttgattaatgtttagacccatttataaacatagttcattttcttctttatatattaaactacatttataaattatacatatttaatttcctttttaaatactccaattatctaacagaactgttctgggcatcttaataacttataaataaataaacaacatgaataacttagtattattatgactccttaaatatcaccctactaggtttaatctcagtaaaagtcctgcttagtatcacctgtctaaattgattacttaattatatatttaaattagaattacaaatatgataaatactaatatgctatatctcataaaaattacagctaaactgcacagatttcttaccataaaaatagtaatgcttggggcttcttctctaaaacatctctgtatggaattctaactctttctggaggtagaagacacttatctactgagaaaacatgaaatgtcaaacagcttgggcagtagctttccgggcacctttagggatattttcctagtggactgaggtttcttaataaccagagaagtcccttgtagagacactgactagcatcttgtttgtaaaattcaatccctgtctgttctaaggtgtatcaaagggctgtatcaaagcttttcctatgggtctatcataccccatgctccgtagattcatacatttattatctgtctcttatggcaactcacaaaagccagccatcccataacaggtggctaagcctcttgatttaactcaacaagtccatttttggcttcttcatatttgaatttttctcttgtttctcctgtcttcagggctgcaactagaaatagaattcaatcttagtgcataatgagtgacgtcatctgcctgtagttacagttctaggtctgccaatgcagaagtagtggaattccattctgtaaacatgcactgtttataaaatccaaaaaaaattactatattcattgtggggtaaacaatgatatttttcaagtagatatatgggaacatttagatgattcctagaatgtaagataaatattaatcacctaaaatgccaagggtggtgtccagaccagtttctcattgtgctgctcaaatatatatcagattggtaaataaaatatttgatcacaaaagaggaggcattaacttttaatttcagctctgacacatgaagagcttgtaggccatcattctcatctttacaacaagaaaaagctggaggccaggctgggtggctcactcctgtaatcccagcactttgggaggccaagacaggaggatcacttgagcccaggagttccagaccagcctgggaaacatgacaagaccttgtctctacaaaaaatagaacagtcagctgggcatggtcgtgtgctcctgtaaccccagctacttgggaggctgacgtgggaggatcacttgagtgcaggaggtagaggctacagtgagccgtgatcatgccactgtattccagcctgagcaacaaagcaagacactgtctaaaaaaaaaagaaataaaagaaaagcctggaaaaactgaaaatcaacaagttttcttacagagaactgaattgacagagataaactctcacccggaaatctagggagataggtgtcacagcgagatacaacaacagagattggcttacctggaacagaagctgctgggccagtgaagtagcaagaacaagcaaatggcaattttggtacagtgttggtggctgagtgtggactggagtgagagtgaggagctcctaaaggccaccgtcttggggtcgtcctcacactttcacagactttctctctaggaaccttaccagattctcacagtgaagatcaaaccttctccataacaaaggtctactctccacggaaaatttaaaaaaaaaaaaaaaaaacctcttccagaaccacattctgaaattttgtctcacctgcaagaaataaattccttcccactccagccctctccagcctacctatatgatctaagttgtgaaaaaaaaaaaaaagcataatcgagagtcaaggcttcagagaaatggattgggcatgctgcagccagagaacagagcagggatgccgggtgggggttgtggggacatctgtgtacctggaagagaggcagacacttggaaggacacggccctgaaacacaggcccaaaaaacactgagatttaatcataagtatggaacactccccaaccctcacaacttatgaccacaaaaaaatcaaactgccagccaatagcagaaagatagctgtaaaatcctctaatatctgggaattaacacaacacactcttcagttatcccatgagtcagagcagaagtctcaagaaaaattgaacaatatttttaactaagtaaaaataaaaatacttattaaaatgtgtggtttgcagcaaaagcagtgtttagagtaaaatgtatagcaataaatccatatattcaaaaagaagaaagatctcagatcaaaaacctaagtctacacctgagaaaactagagaaagaaataaaagaggggccactatgactggtcccatcgactttaaaaggtcagtgctcacagatttgattattcagataaaattggccaattccagaagttaagcaaagagaaactgataaactgaatagtccgatttctattaaaataattgaataaataattttaaacctttcaaaaacaaaaacagagcacaatgttcagattgcttcactggtaattctaacaaacatttaaagaagaactaataccaatgctccacagtcttacagaaaacaaaagcagatagaacacttcttcacccattccattagtctagcattattctaatatgagaaataaaaacattgcaagaaaagaaaactttgtaccattatttcttatgaacatatgatgacaagtatagaaaaagatgctcgctattatttatcattaggaatatgcaagttaaaatgaccttgaaatagtactgtgcatctattagaatagttaaaatccaaagatctgatagtatcaattgctgacaaggatattaagtaatagcaactctcattcattgctggtgggcatgcagaagtatagagccagctcgacagtttcttacaaaactaaatacagtgttgtcttaggatccagcaattgtacacctgggtgtttgcccaactgatgtaaaaatgtatgtccacataaaaatctgcatatcaatgtttataacagctttgttcgtaattgccaaaaatttggaaccaatcaagctgtgcttcaactgatgaataaatacaaacttttgtttggtacatctctcgacagtagaatattattcagctataaagtagaatgatgagtcaaaccactaaaattaagtgcatattaagggaaagaagccagtctaagaaggctggatactctatgactccatttttatgacattctgaaaaaggcaaaacaatagagttcagaagcagatcagtggttgttagggatttggggaaaggagaggactgaacaggtgaagcatgcaggacatttttagggagttgaggatattatgtatgataatgcaaccatgaatatgtaacaccatgtatttgtcaaaaccacagagccttccagcaaaaagaatgaatcttaatgtaggtgaattaaaatgtaattaaaattttcaaaaaaagcatttaagaggtcatgggaccccaggatgaaatggagactgtgcaaatcaatctaattgtattacaaatgagttaaataactttactaattggatgctgacctaagtaactttggagatgaatggaagctgtatgactaaaggcaaaaagaactatacctaaacattgcactctggttgacaaagttgtttctaacagggacttacttctgaaactactatacatctaaactgtaattaaacaattagggccctgggtggcagatcatgggagttgggtttctcaccatgaagtgggagtttacaaacaagctagggaagaggctagaatgagctgtgtggtacctgattagacttagagacatcagtacgaactcatgtttagctgaatagagatacaatggatacatacaggaatattcatagatgtgtgtatatacatgtgttagtatacacacatttttttttctgtcagctaagagaacctggaagcaaggaacaatgccacagtagcaataaacacaactgtccccaaatcttggtttctaataggattttccaataaaatgaaccaggactcctttgagaacgctaattctaagactggtaagggaatataaaagaacttggaacttccaagcacttggaacttcttgtagagttagaaaataaagaagtaccaagaaaaaaaaaaaaaagaaaagaggtggagggggaaagaaaggataaaataaacaagcaatgatggtgatacatcaataggatgtgggagccacctgaaggagttcccagtggttaaatctggaatcatttgagcaacagaacaaataaggcggtattggattataacccaaagtttaaaataaatacaccctgataagtgtatcagtgtaaaataagtgataagtgtaaaataagcccacactgatataaatgattgaataaatggtaacaatagccaaattttcctgacgaaagaattccaagtaatttatgtagatataccacctcaagaagatgaagcataactctcactccttatgtgtgggctttgcagagcgacttccttccagaaaggacgacatggaaagagaagctttccagtggagaaacctggcaggcaccaccttagccaggtggccaaggtcaacagcgacactgataagccctgttgatagcatttacccttgatatgatgtgatgagaatggtactttacctccgtagtttgccccttcaaaactctcataacctcagcctaaaaatgagaaaaacaacagacaagccccaactgagaggtattctacataattcctgaccagcattcctcaagactgacagtcatcaagaacacagaaagtctgagaaactgctacagaggagcttaagaagacatgatggcagaatgtagaatgggatcctggatgggatcttgaaacaaaccagggacattaggtagcaggtagggtcatctgaacaatgtatgcacttagttaacaatgcattaatagtcattcaataattgtaacaaacgtgccacactaatgtaaggtgtaaataatggaggaactggatgtggagatgtgaagtatatggggacttcctgtgttattatctcaacttttctataaatctaaatgtattctaaaatgttgcttattactttgaaaaaccaaatagaagagcaggtatcctcccaggtgtaccagtaagggtagcagtgggggaaaggggtggtactctgtagctacagacctcaaaatacctgtatgatcttaagacagagtcatcacatttcaaattctgagaaatatcatgggaagaacttgagacagctgctaggcctttagaaaacaatttaccccaaatgttgtctactattggtaaagtagcatttcctatcagcctcagtcttgtgacaggccacaaaaatgacccttttccaaagagttggttaacatgccataagatgcctgccctgttctatcttcaggaaggtggcagctgggaggctgagtcattgtgctgtgattctcacaggatgcacctgtcttctggaaaagctcgaagccttccaaatgctttagtgctgaattctcaggaatgtggcttcagaatgggccagagtcaaccatgacacattttatcccagcatcagtctttgatccttaaatgatttttttttcctcctagagcctaagaaactactaaagaaaatgtggtacatatatcatgaaatactatgcagctataaagcagaatgagatcatgtcctttgcagggacatggatggagctggagaccattatccttagcaaactaacggagggacagaaaacaaatactacatgttctcacttacaagtgggaactatatgaggagaacgcatggacacagagagagtaacaagacacactggagccttttggagggtggatggtgggaggagggagagaatcaggaaaagtaactaacgggtactaggcttaatacctggataatgaaataatttgtacaacaaacccccgtgacacaagtttacctgcataataaatgtgcacttgtacccctgaacttaaaataaaaattttaaaaaatgttaaataattgctgaagtataaacaacataaatggcaaattaacttttggattggttaaagatctatattgctgttcttgaaagaggtctctaaacattagagaatgactttgggttcatttgttacagcctgacacaatgaggtctttgtggagggctgcatgggtttgggacattttgttgccaccaggcctcctcacttagctcttgtccgtatctatatttctttcatttcgtagccaaatagaaaatatcattttaatatagaatctcttctgctgcttgatatctctcccgacattaaaatagcacccctaaagaaatgcaaggaagtgaactgagctattatcaactcagtgttcaagggagaaatttctgtttcaatccaagaaaatccgagaacccactgaattacaaagaattgtctaccaagtaataaataaaactatgtgttccacatttgtgtccgcacattgtcaccaaactttctgtgcatcttatctatgttccttattgcagagttcactaccatttggggagaaagtcaagagcacaggttctgagggccagactgtctggctttgtatcccagctctgcgatgtactaactccatctcttccagccttagtttctccaattgtacaacagggatcataagagaacacatctcattggatagataagtggacgtgcaagagttaatgcatgtaaagcagttcgtaaataagtgctatttatatgtagaaagtctttatcaaacccataagggaatagatattttcatgttggaatcattgcctttcagtgtgaaaatatatcaatgtagtgatggttctgggatcttggtcaatggtggagcatcaccaacacacttgtgtctgattccaagaaggtgttggaggacagggggactttctctgccctctactttcttctccccttagttcacacaaatcgaggctctgaggcctggggaaaagtattgttacctttgtgttctctccatggtcccaacaaagatcgtgtggaccccagcggtaataggtagggatagggaagcaactggcctccgggaatatagagacgtttatcaacaaggtctgcactatctcaggatggatggcggggcctcttaatccctcaacctcctggatgagggatccaggagggcactgttgagtccacacacaaagaagggtggaggagaagatgtcatggcttctttcatatctggcaggattttagccgttttgaagatagagaaggcttaaaggttgaaggtgggaaaattacaaattgtagagtatttgagtgggaatgaatgtgggtaaggggttttgagaggctgtgcctgagatcgctgggggaagaggctgggatggcaatgagcttctaaacacaaggcagatgtcatgggcttggtccaaagggcaaggtgcagccgtgaaatgatggtcaaggtcaagtggttggggcaggtcttgtaaacagaaatgaaggcaggcagtaaagagaagggaaatacaagtacgcatatgtgtacactcatctatcattcacaggcttaccttgttggcaggaggatctgagtctgagaatgggcagtgtctttcatgcagttggcctggccaatctcctgtgaacagggatgtttcagtgtttaccagtacacaacctgagtgtatggtgtgtgtacctcgtgtgagtgtcatgtgcttcaccttgtagcatgcacagtacctccttgaaaaggtagtttctaattcaaaccaacttacatttttatcaagagtccatagagccaactacatgtgggattgaatgttcaggtgaccgacaattcaatttaggacaaaacatggacttgttatcttttttgaagtgtcctttttaacttgaatattcactggcatataaatatgaaacgtaagatgtagccttagagatggttgtcccaatagctgtcatttgagaggatgcagtgtctctgatactcattttagaaaatatgaaagcaaatttttatgtttatttttgactattgtaaaatcttcaaatgcagatttaagatgtcatttattgccaattgttgatttttgctcatttgtgcatcaatattagtttatggaattgaattctctttttgcaacgttattgataattttagtgtatatagtagaaggctgcatttcccaagcagtctttccccatcatagagctcttcccatcagtgtcattgcctctagccagacttcttatgtttctgatgaaatgtgaaagataagcatattcctgcaaggaaaccgtaattgttttcaaagaggagcaaacatctttctttcatttcttctcaacattcacttaaacaattgactaagaacaaaactaccagagatgtgtaaataccagagacatttaaatattaaatatgatatccatttatcaccagatttattctcatttgcaatttaaccagatcttgtttgaaatagtgttggtgttcaatgatgcatgagtgataatcaaccagttaatgaaagattatactgctttgatttcttgggggagaaaaatagactgaatcataggatatttaaagagttcaaaaattctttttcagttaaaaaatccccatttttatacctagccgaaggttttctcaattccctagtacatacattgttatgacactgtgggttattttgagaaattcattttgcttcatcctgatttcattcattcttcacttctctgaaatctaggaaatgcaagtgcattccccagggacccacagcatgtggggtggggtaggggtttccagaagctctccatccttcctgatggaggcaaccatcacatgggcctatctgggcaggtgggaaatatgagagggcatttttgagcaccctctctgttttagagaggccattaaatgtgttcacataagtgttgtcattctcatactcagaaaccattctaaccttcataagtgaatgagagcaactttttattaatgttgtaacttttaacaatttcacattgaaatatagcctaggcattttattagatcatgttaacaaccgctattgatgacttaaaagacaaaaaaatctatttagatagatacatggatgtgtctgagcatgtgtgtttctaattataatgtgtatatatgatatgactgtagaaaaaaaaggtaacttagattttcgttaaagatgtttaaaaatactcttctggttctgagaaaagctgtcttcctattggagctttttttacctgtgtttaggaagcccatatgtcatgctgcaagaaaagaatgtgtttaagagctgaaaatggcatttcccttaggatagtagcagctggaatgaaagcggtgatgatggcaagttcaacgtggctcagaaatgacttgaatgggggctctcaggctcaagtgatgggctggtctctgggttgcaggactaaggaccatgttcaggtgttacctggggttcagggccctgcagcctggggacctcctcaaagctgctctgagggtgagtctcaggaggcaactccaatcctgcaccttcctcttggctcccacatcgggagcagggactgagggcaggctgctgggcaggtctcctggtgtcaggaggggaaagagaggccacaccggacacacctgagaagggaacaaaggttggtagggatgctggaggggagcgtggtcatgggtaaaagaatattgagcaaagaacatttccagggattaaagtttattatatttgcagatttggccctcattctaagaaacttccattagactttagatctttaatacagatcagtatagatttcaaactttaaaattgtctcaattatatagaaggacacttctcaagatttttgatcctaggaccactttataatcttaaaaattcttgaagattccaaagggcttttgtttctgtgggttggatctatcaatatttgctgtactagagattacactgagatatttttttaaatgacaactatgacatattatcataaatatacttcttaataaactatttttagaaattggtgagaagaggatgaattattttacattttttgaaaatctctgaagtctggcttgtagctgcttctgcattcaatctactgtgatgtgttatgttcgttgaagcatatgaagaaaatacaattcgcacagaggtgtagttggacagggaagcttaatagcattttcagatcatcatggctattgctctttgatactctaccaaaatttggcaagcggtggtttttaaagattaattcccatgcagaaccaaaaaccatatcaacagccttttcctaccctattgcattaaaatatatcagtgtttctggatcttttacacatgcatgattttataacaccatgcattggtttttggaaagtatttattcacttagtaatgtagacgttccaaatgttgatgcactccattatacaatacttttgaaaatcacatttataatatcactactaatgtcatccaaaatatctttaaatattgggaaggtgtgttaagcatgtggtgaagaatccaagttttctaaaatcgaattaagacttaaaagctcaaattttaccactggcaacaaacactctcagttgtttcccttgaagtgacaggctcacttcattccttttgagaaaatgtttgtcaaatacccagacaaaaatagtttatcagtttttctttcaagtagaaatgtgttccatgaaaatcacagctgatcagctcatattcagtcccacactggagcttttcttgagcacccaacacacaggtgctttgtatgtttctgccattctgtcacacagaatgttaaaaacgcacaccctcaatggttgagatggaatgaaatgaaatgatttccactgcttagtcaaggacatgctgaagtgaagctgccacgtttgtttttgttgcgagtgttgacggacaattgtgaagaccacaacggccgtgagaagagtttggtgccactgccttgaatcctattaaggccccagcagatttgcccactgttgcttttgtactgttggctaaaaaggcaaataattttttagtgttattctgaaaatagctctgatctcacagatcctttgaaaaagtatcagggatcccaggtgttgttggactgtacctgagatcagttgatacaaaacaatcttatgattactatttatatgtatattatatataatatgtattattttatattatgcatatcatatatattttatgttatttatataataatcctattacgtatgtatattatatatttatatattatacatatatgtattatacacgtacacattattatacatataaatatacatatgaaataatttttcaggttatctagatcttggatctgagtaatccaatcaggtgtctgattgtaatgccctctgcaggctgggtagtgtggtggtggcatgggtgggacaggtagtgtagttctgggagagatccgtctattattcatggtttcactctactcaactctttgaggctctcaactctttttcatcctgtttgacactccacaactcttgcataataataaacagaggtactatagtcaggcaaaaatgaatttaaatccttactttgcttctcactagccatgtgaattgtagcaggtttctgagcacctctgagcctcagtttctgcatctgtgaaatggagataatacaaagctacctcctaggatggttcagagattaatgaaattaaaacctccattgatggagtgacctcagacaacacgttgtaaaagtaagcttgtgcagcctcgtggcccagtgagcacagtgatgagcgcagaaggataaatgaccaccttttggttgggtgctagggtgagcctgctgcatttcctaccgcttttcacacatgcacaatacctctatccaccttggaatacaaggaaataaattgtgtcctgcatctgtttcttcagtcacagttaagctgtgaactctcatggggagtctcatatagctattctaatacatcctcatcactgtgtggcaccaaaattgtggagactttttattaaagattatacagtgttagagtttatcatagcagagtttgcataacatcaaatttctttatagtctatttatgtaccatggaggaaaaccattttaattaaaaagtgggataagctaatttatctcttgaataccaaatgtcttaacctcaaaacccaggctaaggttattcttacaaatacagaatgttttcagaggagacaaaatagtgaattcagtgaatattttgttgtacagtccattctgtattttccttctacattttatttattaagtcagacatgtatattcactttaaatgaaactcttctaatgcttgacttggctacgtttggaaatagccactcgaggttggttcatggagaaagaggtagctggccacacacagacaatgactctccctcaagtgtacacaaggtgctcacatcttcccaaagcctgcttccaggaccccaggccacagtggatgtgagagagacaggatgtcatgttgaaaggcagttttatattgctaaggctcccataacacagttaaaaccaaagatcaaatctaacctggcaaaacgttgaaaacagtttacagctgtttgttagaaaaagttaagccattaactccttagatagccttgattcccgttttctttttgtccacagctatttagtatcttttatggaagtatagaatatttatgtctgaactgcaccaaacatattcaaaaatgctatttggtgtatatataacaaaagtaaacatatgtaagatttctacctgttggcatttgtattaatttacaaacatttatgaagtagaatgctactcaaaaaaattcatttaacttcacttgttggttattggttttattaataaacatatagagaaacaaaataaatgataatatggaatattggcagagatgcacaaatatttacattctgatatatcatttggcaggaaaattttttaaagcaatttgacaaaatatatcaaaagccaaagacagttaatgtcttttgactcattaatttcacccttaattatctataccaaagaaataaaagttatagacaaatatttatgtagaaagagtcaagacagaactttaaaataataaaaaattgtttctctctaaatagcttaatgaagtgactgcttctgtgaatggtggtgcatcagcctaattcaatattatgtggtaattttaaattatgggtttaaataagttttcttaatataggaggcagtcgtataatatagctgcatttttaaaaagcaggatttgaccaccatgatcaagtaggctttatctccaggatgcaaggttgattcaacatacacaatcaataaatgtgatttatcacataaacataactaaagacaaaagccacaggattatctcaatagatgcaggaaaggcttttgataaaattcaacactcattccatttcaaaactctcaataaactaggtattgaaggaacataccttaaaataataagagctatatatgacaaacccacagccaatatcatatggaatgggcaaaagctggaagcattcaccttaaaaaccggcacaagacgaggatgccctctctcactgctcctgttcaacatactattgaaagtcctagctagagcaatcaggaaagagaaggaaataaagggcatccaaataggaagagaggaagtcaaaccagatgacatgattctatatgtagagaacttcatagtctcagcccaaaagattcttcagctgataaacaacttcagcaaagtttcaggatacaaaatcaatgtacaaaaatcactaattcctatataccaacaacagccaaactaagagccaaattagaaaggcaatcccattcacagccacaaaaagaataacatttctaaaaataccagctaaccagggaggtgaaagatctctacaacaagaattacagaacactactgaaagaaatcagggaagacacaaacaagtgaaaaaaaaaatcccaagctcatgtataggaagaatcaatatcattaaaatggtactgccaaaatcaattcacagattcagtgctatagctatcaaactacaaatgacattcttcacagaactagaaaaaaatttttgaaattcatatggaaccaaaaaaagggcctgaaagccaaagcaatcttaagcaaaaagaacaaagctggaagcatcgcgttacccaacttcaaactctactacagggttacagcaaccaaaataccatggtaatggtacaaaaacaggctcatcgtccaatggaacacaatagagagcccagaaataaggtcacacatctacaatcatcttagcattgataaagctgacaaaaacaagcagtggggaaaagactccctattcaagaaatggtgctaggataactggctgaccatatgcagaagattgaagctggacccctttcttacaacatgtacaaaaatcaactcaagaaagattaaagacgtaaaacccaaaaccataaaaaccctggaagacaacctaggcaataccatcctggacacaggaatggcaaagatttcatgaaaaagataccaaaagcaattgcaacacaagcaaaatttgacaagtggaagctaattaaacttcagagcttctgcatagcaaaagaaatgatcaacagagtaaacaacctacagaatgggagaaaatatttgaaaactatgcatctggtaaaggtctaataatcaggaacttaagcaaatttacaagaaaaaaacaaaccaccccattaaaaagtgggcaaaggacgtgaacagacacttctcaaaagaagacatatatgtggccaacaagcatataaaaaaatctcgatatcactgatcattagagaaatgcaaatcaaaaccacaatgagatatcatctcacaccagtcagaatgactttaataattttattattaaaaagtataaaaataacacatgctggagaggttgtggagaaaaaggaatgcttatacactattggtggaagtgtaaattagttcagtcattgtggaagacttgagtggggagagtcagaggagggagaggagcagaaaagacaactattgggtactgggcttaatacctgagcagtgaaataatctatacaacaaacccccataacacaagtttacctatgtaactaaaccttcacatgtaccccaaacctaaaataaaagttaaaaaaagcaggacgtttgaaaagtatatgtatacatatatgtagtattatgttgacaaggctcagaaatcatatctttttagatagaagaaaatgtgcttgttaaaatggttgcttctctcagtattacaattatgaatgatatctttctatgcttttttatacttttctgcatttttcaaaccttctgcattaagcttctattcatttgcaatcagaaaaatataatcaagaaatgtaatacaataataagatatatacatagtcttctgagacttcaaatataaaataatcttgaaatgatgaaaatctttgtcatggcatttttgagaaagggataacagatattctcttttagaaagccaggttgtgttttagagtttgaggagagaaatctgtccactggtcccttttctggcctgggaatggaatcattagttgtgttcagtttttcagacacagccatctttgttttctacttagggtgaccgactttgaaaaataatgcaaatgacatgagattctcggccaagaaaagacattggtcacttagccctgccaaggtgtcctgtctgttccatcacattctaacagggcagcagctccaggggggaggtagggcagtggctgccttctcatgggggcactggttggctgcgggaggggcctcctggccttactgctgggtgttacctgtgctgctgtgacaacagtctcatctgccaggtgcaaaatctgctctatgatgaacaatttaagtgatattccttgtggttgcataaatctagtttaaacagtattgacattttcctatactcacagttctcactttggttttgtaactgatgatgcattaataggtgttgattatagatatccatgtagataagcctatgatttctatcaagattctaaaatagacggactttgcctctagaggtttttaaaagctttttttataaagcaaccagtttaatataaatttcataaaaaaatggatcattggctgggtgtagttgttcatgcctgaaatcccagagctttgggaggccgaggtggaaggatcacttgaggccataagttaaagaccagcctgggcaacatattgaaactctgtttctaaaaaaaaaaaaattttttttttaaattaggcaggcatgctgacacatgactgtagtcttagctacttgggcagacggctgaggtgggaggatcacttgagcccaggagtttgaggttgcagtgagctatgatcttgcacaccagcctgggtgacagagagatcctgtctctaaaacaaatacaaaacaaaaagggctcatttgttttataggaggccaaaagaaatcattgcatgtcttgacttgcttagcacttattctgaagaagaaatattggcgtgaaatgcatgtttataactgggtccttcccatagtagtcttgagcacaaataccaaagttgtttttttttttttttaaaggagaagaaaaggagcagtttcaccttttttatacagaatgtagacaaaatggcagtcatttatgattgatttgttctacctacttagcatgcagggactccccagtgtggtttttaaattaattagttaatttttttctttcattagttttaatggtacaagtggtttttggttacgtggatgaatcgtgtagtggtgaagtctaggattttagtgcacgcatcacccaaatagtatacatttacccaactgctagtttttcattcctcacctccctccccacttctgagtctccaatgtccattacaccactctgaatgccttggcatacctatagcttagctcccacttataagtgagagcatgagtacctggtttttaattcctgagttacttcacttagaataacggcccccagtttcatccaagttgctataaaagtcattatatttttttttatggctgggttgcatttcatggtatatatatcacaattttttctttttgtttttttttagttgagtcttgcttttatgatttttttcctttccaactgttattttaggctcagagggtacacgtacaggttttttacatgggtaagttgtgtatgaaccacattttctttatccattcatggattgatgaggactcaggttgattccatatctttttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtacttttagtagagacggggtttcaccttgttagccaggatggtctcgatctcctgacctcgtgatccacccgcctcggcctcccaaagtgctgggattacaggcgtgaggattccatatctttacagttgtgaattgtgctgtgataaacatgtgtacaggtgtctttttgatatactgattgcttcaagaacttaggaactctggagtttgatgcatatatatttacaattgttacatcttcttgtttaattggtcattttatcattatatagtgacctttgtctttttcttgttgttttttgttttgtttttttttttttttttgctgttgttgctttgaagtccgttttatttgatatcagaatcgctactccttgtttttggcttccatttgctggaaatctctttttccaccctttacctgtagtctataagaatccttacatgttcagtggtgtttcccaaagacagcggtgtaggctgctactcacagcttctttcaaagctgtttacggtcctgtgttccttcttggaaaaaagttcacagtgtgaatctctacacactattttatctttccaagtggaaaaggaatgctaacaatgcctatattccatcatcttggaaaaacaaaacaacaagaaaaacccaatgtaaatattatcagcacagaatctttctttataggctccaaaatataccagatgcacacttcatattttatcttgattacatatgccactctttagagtctcagctaactatgactgagtaagaatgtcttagaacacaggctcccacgtccatgagtgcattaaatattcttatttccaaagtggccaggctggctgatagctatgactagttggagagaaagcagcatttatagcctaagtgggctgggcaacaaactacctgaaatccttaggagcaagaatagaagggatgccttgttctctacacccaggtatcactcattgcctgatgtctcgcttcgtgtgtttgctgggtttccgtctgtctaggaaaggaagctctatgggggcaatgactccaatgagtttgtctccctttattcctcaccatgtaggtgtggatttgagtggactccaaatggctgggccaagggccttggataccaaacacagcagaagatgcggaaaggatgagggacccaggggttctgtctttgggggaagagccctgttccctggacattgcctccttatatccctgcactagaatatcgtaaaattcccctagtcaaaacccatgatcctgcatgtcttggagaggctgcctcaaggattcctccttgactccacttattttcatggagaaggaacccctccatccctggcatccttaacagattcccttctagcttctcacccactccatctccaagccaggtttcccttcgcttctagaaataatctgcagtggctgcctaagatgttttctgcgtggaacccaaataaaaatgtaataatttaaattagaattttctacaatcatgtgttgctcatgtctgcattatggatacccaggtcacatgtaggtaagcaattagcaattatggtggaaacaagacttcctaacaggtattttggtggaaacttgaaagctgtttctaaagctgtttattcatgcaaacctcattacagtcctgacagtaaacctatgtgtgcacagggaggcaggaggctgtgaggcagcagcaggatccttcaccccatggctcactcacagtgcactctttaaccaggtcttattatgtccatgcttctggggtgattaaaatatgccctagaagccttgatacccaaaataaagcaaaacgtggaatatgaagtttaaaaatgtgaaataataagtaaaagttttgtgaaatacatttttctatactgttcaaatgatcttgaagatggcatccgtttcttaggtctgccatgcaaaatgaccacgatggagtggcttaaaacaacagacgtttcttctctcacagacatctgaaatcaagaagtcagcagggctggtgccttctggaggctctgagggcacatcagttcctcacctctcccagcctccagaggcttcctcaacccttcacactgctgagcctgtggctgcctcactccagtctctgcctccaccttcacatggcttcttttttgtgtctctgtgccttctccttttctgtctcttatatgacattcttcagtggatttaggacccaccctaatgaaggatgaccttatctagaggttcttactttctttaactctgcaaagactgtatttccaagtaaggtcatattctgagattccaggggttgggatgttgatatatttttgaaggaccacaattcaacccactaaagggatgaaaattaaactgaaaaatatcaacccctaaaaaacctgctttattgccaaccatataaattgctctttgtcacaatatacaacagaggcctcacaaaccttggtgttcttggtgtgagaatggtgaaaaacaagatagaaagcagcctgaaatatgcacaggggtgtgtcatctcgttactgggaaaggatgtactgtccaagcgacaactagactgcagaggtaaggctgagaccagggctgccatggtgtttagattgaacatgaagttagaattcttaagtatcaaaactaaattcatgttcaatctaaaccccatggctatgcctctcaaggtgaggcctctgtgttgttctctatgccttgagcacccttccttctttgcaataaaaaaagttgcagaattgactgggcacagtggctcacgcctataatcccagcactttgggaggccgaggcaggcagatcatgaggtcaggaattcgagatcagcctggccaacacagagaaaccctgtctctactaaaaataaaaaaattagccaggcgtggtggtgcacgcctataatcccagctacttgggaggctgaggcaggagaaatgcttgaacctgggaggcggaagctgcagagagcagagattgggccactgaactccagcctgggcaacagagcaagactccctcccaccccccacaccaaaaaaaaaaaagcttcagaatttcagtctcccacaacaaaacccacacacacacaaatttgtgtagcagctactatttgccaacaattagggtctacacaattaagacatcatctttaacctcaagcagtttacaatccagagggcaatgatggaggagaataatgaggtgtggataaaagtgcctattagcagagtatgcagtggaaagtgtgataacacttctagatagaaggcagttggtccataggtattttggtgagaatctacatgtctgatgcatcatgggctgtaccaaggacaagtcactgcctttggaaatgtttgactcatgccctgatggataggtggataggtctacacatcaaaaatgcatgcctggctacacatttatgagaacaacaaaaattttttaaaaattataacgccacatgctggcaaagatgtggagaaactggatctctcatgcattgctggtgggtatgtaatatggtgcagacattctggaaaactctttggcagtttctcataaaactaaacatgcacttaccatgtggtccagcaattgttctcttaagcatttatcccaaagaaatatgaatttatgttcacaaaaagttatataaaaatatccatagcagctttctttatagtagctaaattctggacaaacagcaacaacaacaacaacaaaatgaatgtttctcacaggtgaatggttgaaaaatctatggtccatccatagtttggaatgctgctattcagcaatcaaaagaaatgaactgttgacacacacaataacctagatgagtctgaagggcattacgcttagtgaaaaaaagccaacttcaaaaagttatctttataaagcattctcaaaacgataaaacagcagaggtggagaataccttagtggatactagtagacaggtacaatgggtaggatggggccaggtgcaaacacagacagataggaataaggaattcttctgtggtgtggaatagttcctcatttgatggtggtggtgggtacatggacctgtaatgggataaagttaaacggaagtatacacctacagagctacacgagcacatacacacaaatgaatgtgggttaaaaataatgaaggtggccaggtgcagtggctcatgcctgtaaacccagcactttgagaggctgaggaggatggaccacctgaggtcaggagttcgagaccagcctggccaacatggtggaaccctatctccactaaaaatacaaaaattagccaagcatggtggcacatgcctgtaatcccagctactggggaggctgaggcaggagaatcatttgaacttgggaggcagaggttgcagtgagccaagatcgtgccactgcactctagcctgggtgacagagcgagaatccatcttaaagaacaaataaatgaataaaagatgaaggcatctagtctactggataatgttaactgggaatgttcccatgtgggtttcctggctctgatattgcaccacagctatggaaattcacaacatggccagaagctaaaggacacacaggactctactatttttgcaacttcctaggagtctgtattgcaaaactttagctttgtaaaagtaaatgccaaaagatatatatgtgcaataaatgtgaatatatacattaaaaagttgtgggagtttggagaagggagagccccttgtaggggtgaggtcagggagggctccatagaggaggtaggacgtgagtttaacctggaaggtggaatgaaatccaacttgaagaactggaggtaattttcagaatggcaaaacagtgccagccagtcatacctggaaaaggaaaaccatgttctcagacctcaaaatagggaatgggggaggtggagaaacatacaaggtatgtttgagtgctggggtggaatgtctgggtaaagaaggagttagtgggtaactggaaacataggttgcagcaagattataaaacgtcttaacttttaagctgtgaaaactgagcttaatctgtaaatagcaggaagacattgtaaattgcaagtgagaggatatcatactggaagttgcatgtgaggaagctgagtctggcagagccctaggatagactggagtggaaaaggaagatgaatgagcgatgagttataatgccatttcacagcccagcacaggcatcctgattatggcttgcagtaagctgatggtcacgggcctagaggggacaagtctaatttaaatgatgctatgaaccttgaccaagaaggaccaggccactgattgccttggggacctggaatccatccaaggaggagcctgggacaggaatagggacagggagaaagcttggaaggaaaggtgccacatttcatctgtctcatgttgattgtaaggggatggtgtgccttccaaatggaagtacctggctgacctccagagatgggagacagcagctcaggagagagtggtcagggctttataagaaataatcgagacagcccaagcaggtcagatcagcaagggtaagagtggaaaagagagcagaagaggaagaacagaaatgtaggagtcttgtgtgtgcaggcatcgccatgcaacgtctatgaaatgagtagtttctcacttcatccagtcttcttcttggcattttgctcaaagcctggcattatactggacaggtccagggttggccacacaccctgcataaccttctcactcatcctcccccactgcttccttaacaacctcctgtcactcactgtcatcaaggcggaagcatgtgcacttcacttcatcaaccatggcaaccagctctgagagtcccaagtggaagacgatgaggggagaatcactcattgtcctcgtggctacaggcagcctctctgagcccacagaacctcacccctacaattaatcctgaatgcgagttctcaaaatagtgcccgctcatttagctgtcagctgtcttgctcttagagcttctgaaaagaaatcacaatagctcagacctcatctttgaggggctgtttgttttgagggctttttccttagttgcatgcttcctattgccagcaaaaatttcttaatcttcctagaggatcagattggcctgttttagatttttaaatgaaaggttaagaggagggaggagtagggcagtgaaagccgcagctgcctctccatatttctgtttcgcaacccaaggggattttgtgtagggctaaatggaaccccctacggataacagttatgtcaggagatctttctgcatgttctcgtcatactcaaaatgttccttcacatgtaagttagagaggacatgttacttctttccccagctgtttcctggtgagtaagaactcctgaccatgtgagaatatgagagcatgcagcactccaagatccttggggaaaacaatgaaagcaacagctcagtgagccattctccatgctcaaccgaaaaccctttgagattcgctgccactttctgtgacaatggaattgtggcccggtttagcccagaaatgtgttgcccaggctggagtgcaatggcgcaatctcagctcactgcagtgtctgcttcccaggctcgagctattctcatgcctcagcctcccaggtagctgggattacaggcacccaccaccacacccagctaattttttgcatttttagtagagatcaggtttcaccatgttggccaggctagtctcaaactcttgacctcaggtgatccacccacctcagcctcccaaagtgctgggattacagataagagccaccatgcctggccagtgctgctcaaatttgaaccaggaatatttgttgatgggaacatacactaaatctattactccatggattccatttttattccattgataatgtattataggtattattaggaactaacttgtgtctccccctaaaattcgcatgttgaagccgcaactcctgctgtgactgtatttgaagatagaggcttaaagaggtgattaaggtaaaattaggtcctaagggtagttctcatctaatctgactggtgtccttctaagaagaggttagcgtgtagccacacacatggaggagtgaccgtgtgaggaccccaggtgaagatggttatctgcaagccacggagagaggcctcaggaggaatcaaccctgtcaacaacttggtcttggacctcgagcctccaggactgtgagataataaagtcctattattgaggccaatccatgataatttattatggcagacctagcaaatgaacacagatctatctttctgagactttacattatagtttttgtgttttaggggctgaataatatgccacttatagatgtgtaattactttttaagtaactgtgaacatttatgttgtgcctaaaggctcctataatcaataagattgcaatgagccatccttatacataaactatgcacatttatctaattaatttcctaggataaaatacaagaaaaggaattacagggtcaaaagatctgctcacacaacatatttttacacctggccaaactggcttcccagaagactgtaccatcagacatttccattgcaagactagagtgccagcaccccagtccccacctcctaccaaactggacactttcagtcatctgctctgcaatggcaagaaaatttcacagaaattaaagaaattatagaaagaatttgaatatcttggtattttaatattgaaatttccatttgtttaatgaattctctatcctttttcactttttctgggattgtttttagtatttataaatttatgttattgcataataatacttttttactatagttacaattttttttcggtttgactttttaaaaattttgttttccatatttatttgtttgcatgtttattgccatacagaatctttagcaggatgcattgtcaaatctgctaagcactatctttgtggtttctatcctggggtatcatgcatgcaatgtctttcttttcttgaaatggaaaataaatcacctaaattttctttaaattgtttttgttttgttttgagacaaagtcttgttctgctgcccaggctggaatgcagtggcatgaacagagttcactgcagccttgacctgttgggcccaaggggtcctcccacctcagtcccccagctagctgggactacagtcatgtgctaccatgctcagttatttattattttatttttgtagagatggggtcttgctatgttgcccaggcttcttttgaacatttttttttttttttggcaaatcccaggaaaagcaaggattagaaatgtttactaccacattattgggatttttaaaaaataaaagcagagttttaacttacttgatataacacatccaaatagctatgtggaaatggcccaggaaatatggttgatgctggaggcacccattcctctcactgggtctcaatgtgtgccctcctccaccacctacccagctgtaccattgtacctcaggaacatgtagaatgtgcagcctctggagtcccccctagacccactgagtcagctccacaggtcgggcctacccccgtgtgctaacatgccctccagaggatgctcacagcctctgctctgctacccagagctgcctccttgacccctggcctcaggtgcttttccccagcagtttccagtggattcatcctcacatcctgttcctgtcattagggacacacctactgggatgaaggtattctggtgacagctcatttgctattcacacaggcacacacagactcacacgggtgttcaaaggtctctttacctagacgcactgacattactatccttagaactgggtggagttcagagagatacagttagagcacaggttacacgttgtgtcagatttcacagttccctctgctttgggcatcccaggctctctaagaggaagcaggtgctgctgccaatgccaaaaagcctctgtgggtgagatagttccatgtcgaatataaaaggccaaatgtggtaaaacctccaatacttattgcataaatcctccctaaatgggatggagagagcagtgcaacaatctttcttcaggagaaactataggtgatgcttttaaacattatttactatccttgaatgtttttgaaacatgcttaaatatcttatatgcctgttttatatgtgcatatggggaaatatacaatataatattcaccgaggcaaagaattggggacatgatcaaggagatatttttaatacttcaacagatcattttttgtggctctttagcttgggaccttgtgctgtgagaggcacaagtttctgtgttcaagagaacacttttttttttttttttttttgagatagagtcttgctctgtcacccaagctggagtgcaatggtgcaatctcagctcactgcaacctccatctcccgggtttaagcgattctcctgcctcagcctcctgagtagctgggattacaggctaccatcaccatgcccagttaatttttgtatttttagtagagatggggttttgccatgttggccggtctggtctcgaactcctgacctcagatgatctgcctgccttggcctcccaaagtgctgggattacaggcatgagccactgcaccaggcccaagagtacacttacttgcatgaaggagcagtgaatgaaacctgctaaggcccccagcatgcactgcttggcagcactcatcttccttggagctgaatcttctagcaggtttctgcttcatttagagccgtcaatacctcaattagtgtctgttcgtctcccctgggagggacctttacacatgtctcttcatgagcctctgaactttaaaaaccccctgagagttgctgggtcataaaatacctcctgattaacagtgctgtttgccaacaattccttgctccttccatttcccccttcttaaagatgtatcaactgacataaacagaagacacagaaggggtgcagcctgccaacagttacatggaatgtattcctgcaaatgtgccatgcatctgtttacccatttcactgctggatgcagggctcataagcccataacacaaagcaggaaaaagcactggttttagttgcacatgtgactgtgtgtgtgcatgtgcagacacacttgcttgtgttggcatttactcgaaagctaggatacgacctccatctctttgtatcattaatactacagttcagttacatgagaagaatctcgcccccactttgaattatgaaagtaaaggcgctggttctggcttccacaggctgggtgtattccttattctttcagaagaggtgcttttctatctgcaaaaccattggtgttattttgtatctccatagcctctctaagtcagttgtcccttccacaaacctataaaataggccaaggttatagagaccatctgagaactttaaggttttcctttatgagaacgttcttaaataagtaagaaatatatagttgtatatttattttctaataaacataataaaaatgcatcatcttggctttcacacaaaatttgggagaaaggtttcaagataattaaaagtctttaggagccattgccctctagtcttccagcagacacccaggcaggtatgaacataaacacacatccacatccacgcaaacacatgcacacaggcacacacaaaagaatgaatgtacatgcatagaattgcacacgtgctcacacaggcacattcatgggtacatgtgtgtgcacacacgcacacaaatatgggccctacaattaatctgtagcagcaatctctttgaaaacaccactgggaaccctattcttggaaagtaagcagaccatcaccccattctcttcaaaacaagttaacaaaagttagcacttaaaacacccctgttttccttttatcttttacctatgttgttaatattctacgtgatatgatggacacaaccgttatattatttatcaaattcattaatatttcatttaaaacctacataagtgaaatttacttttaaacatattttatttattgctcaacctttataaaaaccacattaaatatttaaaatttttaaatctgtatgatcccattatcttaacactttttttcttacaatccttgcctatacatatatatgaaaagctctttagccgtacaggaatgtacaatgtaattagaaaaccaagtcatgaacacaaatattaactagaaaaaaaactaaccttataagcactttataatctacaaaggtctttgcatgtatttaattgtgttgcttctctctattgaggtgggcatcacccttgcacccatttgatagatgattcagaacataaatacccacctaattttatagcttatcaattggcagagccaaaaaacctcaaagttagctctgctgattccaaagcctgagctgcttctgcaatatgcacgcagggtactagaaaacaaggctctgggtgacgggtaggggagggatgccacaaagaacagatgtaaagcagcccccaggtgggggatgattcagacaggttgtgggaccccagagtgtgcatttctagcatgttcccaggtgatgctggttcagggctgtataataactctgtgtataaaaggaaagaaacaacaggtactatacatgtatggtagatatctgcaaacataaggtggaaggaaagaagccagacacaaatgaatgcagaaaggttgatggtattttacatacagttcaaaagcagccaaggatgtaccaagttgttcatgcatccatacccaggtgggaaacagatgggctgcatggtttaaaattctggctccgctcctctctacctgtgtgatcttgaacaagccatttagcctctctgtgcctcaatttttatactcatatttacaaaacctccttcctaggattgctgtaggtattaaaagctaatacatttctcagcagagaacttaatgcatattagctataattatcatcctcattattacaccagatgtttttaaaagggcatttatgtccttgatactagcatagtcaaatgaaaaaggaatgaaataaatgatacaatccagataaccaaataaaaaaaccatatgggcatcacatgcaagccaatggaatcatgccactaatgcttgaatgaagaggcacagtggaaaatgaatattaacacagatgaagatcacatggtcagagtggtttcaaggaaaaggtgaaactttaggaatcagaaatatggtggagattataacgttgaaggaaggatcaaaatactgggcgttggcccattttggacaagaatcttcaggtagaggagatccctgggacaccctaaagagctattagcttgtaatctctacagcaaccctaggagggggtgctgtaattataggtacagaaattgaggcacagagaggccgaaggacttgttcaaggagataaccagcccagcttccagaagacacagcacactgaacggctgggagccacaggcagtgtgctgtgcagtgggtgatggagacaagacatggtagaattcaccaccccattgagtgctaatggggatgatgatttatcttctctgtttctccatgaaaaacagctgtacataaagcagctgctcaaaagttagaacatggcttcagacatgacaactctgtgtctgtccccaagccacatggaaactgcttgccttctgggaaatgcatctgaatataagagtgaagggtggcgggggtggaatccaccccccagctcccacacagggttgttggcaggctattggcccaagacttgtccttctcatggtcctctccataggccacatgggtatcctggtgatatcatggcaggcttccctggagcaagtgatcagacagaaagagagagaactggggcacccaagtagaaggtagaagctacagtccttttataatctggtctcagagtgataaaatgtggagagtttgaattccaggagatgagattaccacaggtcaccttaaaaactggctaacccatggctcataatatatttttgctgcaattaatatcctggacagcacttacccaatttttcaggatgacatgatctattttcttccttgtttctttatttttttactatcattgatggcaggaaatcaaaatctatttactattttcctttttctacataattattaagaagttttctgctgagtacaatggctcatgcttataatcccagcaatttgggaggccgaagcaggcggatcacctgagattgggagtttgaaaccaacctgaccaacatggagaaaccccgtctctactaaaaatacaaaatcagccaggcatggtggagcatgcctgtaatcccagctacttgggaagctgaggcaggagaattgcttgaaccagggaggcagaggttgcagcgagctgagatcatgccactgcactccagcttggtcaacaagagtgaaactccgtctaataaataaataaataagaagctttcttattgggcaaaatatagtacctatgtacagaaccagacagatggaaaaaaaaaaagaaagaaatggccagcctgcctccatgcgagttagaggaaaatactgtttttgatatcttttggttaatattcatacttgtcttaaaaaataaatcaactttcttccaataatgtgacttgaaataacttcagagtgaatgtaatatgaaccctaaatgttcttcgtctttcccctgacacattcaatcatgtcataagggcctggaaaagctgccaggaagtggagatgttgtcattcttgttcaagcttagcatcaaatatgacccactccagcttggaaacatgaatttgattaacggttataatctaagtaacttcattatgtaagcataataacccagctgaggagatattttagtatgtgctaagaatttgttaattcctggctggaaaaatcattttctttataaggattagagctgcccagtaggcagcctcacttgccgaaatcttatgaacaataagtatttggacaggagaaatttttgattctgcagcagggataatcacacttggtgtttctgtggggccattcttccaacaccctcagagggttcctctaacataatctcattaatcctcattacagccttaggaggcggcaggtctcattgttcttacagatgaggaaacggagatgaaactgagaggcagagaccacaaacagggaaaatactgcttggcctttgaatggcttgagaagaaacaggcaaaaagactcaagccattttctctagcaaagttctacagactctaaaaaataatgttttgtacaccagtgttcacaatagccaaaaggtgaaagcaacacaagtgtccgttgacagatgactggattaaaaaaatgctgtgtacacatatcttgaaatataattcaggcttagaaaagaaggaaattcagacacaggctacagcttgactgaaccttgaggagattatgctaagtaaaatgagccagatacaaaaagacaaatactgtatgattcttcttataggaggtccccagagaagtcaaattcatagagacggaaagtagaatggtgactgccagggcctgggggccaggaaaaggagagaatagggattgtttaagagttgccaagtttcaggttgggaagaagaaaaagtttgggggatgaattgtagtgaaggctgtacagcaatgtgccttgcagctgagaaaatggaaatttcaaggactttatggggagtctcctgtaaatggactcaggccccagaatgaggggcttccaagggtgttctgatttgaagacagactaagaatgtactttgtccactgaaagtgaccaaaatgaccaattttttgttatgtgtattttaccaaaaaaaaaaaaaaaagaatcctgaggacagcaagtattcgctgtgactgggaagatactactgtgggtgttttttgttttttgtttttttaattttactttaagttccagaatacatgtgcagaatgtgcaggtttgttacataggtatatatgtgccatggtggtttgctgcacccatcaacctgtcatctaggttttaagccctgcatgcattagatatttgtcctaatgctctccctccccttgccccacccaccgacaggccccggtgcgtgttgttcccctccctgtgtccacgtattctcattgatcaactcccacttataagtgagaatagtcagaatggctattattaaaaagtcaggaacaacatatgctggcgaggctgtggagaaataggaatgcttttacactgtgggtgggagtgtaaattagttcaaccattgtggaaaacagtgtggtgattcctcaaggatctaaaaccagaaataccatttgacccagcaatcccattactggttatatacccaaaggattataactcattctacaataaagacacatgcacacttatgtttattgctgcagtatttacaatagcaaagacttggaaacaacccaaatgcccattaatgatagactggataaagaaaatgtggcatgtatacatgatggaatactatgcagccataaaaaagaatgagatcttatcctttccaggggatgaagctggaagtcatcattctcagcatactgtgggtgtttttatggctcccaggtgatgtaaggaatagggaccacaggtttaatgaaagataatcgtgatgtattgagtggcttgggaagatgttgattgcaagtggattagtcacttccctcattaaggcttgcctctgtacccattgccttcatgatgggcagagtgggctccctacttcagattccagattgtggttactcatatctaagtcttatccaagagactgccctctcctcagctcttcttattcccctcctgctcaaggtacctgggctgtttctttctactggaagcagtagaggctgcctaggaagtggagtactgtcctgacattcagggacagcatcatcggtacaagaccagtccagtcccacaagccaaagattatctgcagccgccatcttgaattcttaacaattttgtctttgaaattgtgttttgcaagtgaagtccagtgtgacaatggagcatgaacagggtatgtggagccacagctcccatgtcatcccacctcccactgcctctccagaataggttttcagctgttcactttcctgccccctggagccccaggctcccctttcctgcaactgcccagcaatggctatggtcatccagtccatggggatctgggtaagtatgtggagaaggtcagagacagcctcctgtaacatttctgggtgtggcacccctccctgcttctaggtggcagtaccagagagtttacagaggatgaccgggcagggtgggtctccaggtcactgaaggtcacctattcgactgagagaggcctgactacacgtccccaccctggcctgggtatgatgatggtggggatccaggcatgtggtggggcacatgagtgtgcatgccaagtcacagggctgttactgggagttagggagggtcagcacttgaccagccagtatcaccatgccagaggaagtgggatattaaataaaaaataaaggccatcatgacagagggagagagggagaccacagaaggaaggaaaaagctttatattttagaactttaatggcacctttttcctgctttttgaacaaaagcctccatattttcattttgctctgggtcctgcaaattgtgtagccagtctcgtctgcttaattctacaaatatgcaataggcttgcgggagatgtttgggtcttgccttgcagctgagaaagtggaaatttcaaggactttatgaggagtctcctgtaaatggactcaggccccagactgaggggcttccaagggtgttcaggcttgaagacagtcaggctgtcagatacccctgtggtcagacactctgcacccttggcctcctccgctactataagggaaagaggctttgcacttggaatcagaagacctggattctccttctagatcttccatttactagttgtatgactttaggctaattacttagtttccccatcctaggtaattataggtaaatggaattaagaatcccttctccactgagaaacacatgtgttgctgcaagctcatgatatgaaaatgatctgagacgtgaaaggacagaaggacagatgcgttattaactaactgtgctgctactaccatttagctttccagaccctggaggaaggaaggaggaaagagaagggaagagaggggatgggaaagattcatcactttagggattaatgaagatcattttactgtattacttttatggtaatattgattttttaataaacttactaaataaaatagaactttgcattagggataggagagaggcaaggggaataggtctagtcatttccagtcttaaaccccctagttctctgtttccttacttagaaattaaggagaggctgggcgcggtggctcacgcctgtaatcccagcactttgggaggccgaggtgggtggatcgcaaggtcaggagatcgagaccatcctggctaacaaggtgaaaccctctctctactaaaaatacaaaaaattagctgggcgtggttgtgggcgcctgtagtcccagctactcgggaggctgaggcaggagaatggtgtgaacccgggaggcggagcttgcagtgagccaagattgcgacactgcactccagcctgggccacagagcaagactccgtctcaaaaaagaaaaaaagaaagaaagaaagaaattaaggagaaaggggagaagatgtcaagtagaaattaattccaaaattctcttatattctaatctttatttttgcccatttaaaggcggtgtttggtgtctggtttctatttgaccatctgcatagacctttgttaatatagatgcaaatccaattaatctgctggaaatgttttgtctatgtgtctcacttctatttatagcataatttagaatcaacttaaaatagtactcatgtgtcttgggtcatttccatggctagtgtttttattccatcatgtcgtatggctgaaatacttatgcagtatatggaaaagttcttagcacacagtcaacactcataaaaattagctattgttgttattatggcactgtgaaggagaaaacagaaaaaagcaggagacagaaatagagggaggatgaaacagaagaaagagaggggaaagtgaagaaggaaggaagggaaaaatgaagaaaaaattgggagggaggaacagaaggatagagggaaagaaataaagaaaaaaggagaaggaggggaaatggcaattagtgggggaaaagaccttggggatcatcggattgagttgtttcaatccaggctgtatattttaggatcgtctgggaaacttaaataaatccatgcataacccccacccccagggactctgagccaacgtgcggtggggcctgagcactggcctattttaaaggcttctaggtgattccgagatacaggccaggttgagagcccgtgatcccattcagctcctctatgactcaggtgagaaagccaaaacccaggacggccaagggtcctgcccagtcccagcggcaggaggttggagtcagattctctgctcccaggccccttcctcacctttccttttggtaagacatatgtgaggggcaccactctaccccaggcaccacctaaccccacatcacctctgcaggccagggtgcggcagttcctttacctgggacaccaggaggccagtgggtctgcaccctgagctgcagaatccaggcaggtggctgccatcttacagctcgacctttgagacccacgctgatgtatgtgtttacccaaggtagttttaaaatagaataataaaaaaaatgtattcagtaaatcttgataacaaagaaaacacattttgattcaacactgtgcattaaagtgtgaactgtggaatccaggcagtagatacatggctgattggcttcctgtatgtttgaaattttttcataataaaaatttgggaggactggtttaaaagggacttgaaaaaatagctttaaaatgtgtttatgtcccagagcatctccttcttttgacctcccacccgggaaccctgtaattcctgcctcagtttcccatcttgggcattgggccaggtttatgctgcctcgttcttggctccacaccctcctctgccatatctgctctgaatgcctggagggactgagaaacttcccaggatacagacttcctgtgttaaaacactggaagtcctggacaccctgggacagttggccatctcctatgtttggggtgatcatgacgatgatggttttcaaataggaccgatcagagtcagatcctgatggactcctgtatttgggcatttgacaccctttcttctctataaaatgaaagtattgagccagatgcttgtgacaggaatcttgtctcattcgggattatccaggctgtttggtactttctcctgttttcttttcagttgttttcttttcaatctgttttcttttcagcagaaccaggtaggaacaaaaaccataaaaatgtataaggattaattttgcattattgatagagtcattaaaagacttgagagtaaagtttggaaccagtctttaatatcagtgatttattgatagaatttttcattctctctgtatcctagggttaaaaaattaagatattcatcaatttatcactgaattacttgtcaaaacgtacagtgacaaactgttcatattttaattatttaattaataaataagggtttactttcattgataaagttaattattgctcttagcttaatcttactatcttctcagtatctcttgtacgatgggaacaccctttaaaattattaatatagtgaaacactctcctaagtattattctggtaaatgtttaacaattagctattgagggggagaggatggagaaagccgtgatttctagcactcgccaatttcagtggtataaatactaccaccattgccaatttcaagctaaatgggaaagagacatgactgcactgccaagctgggcagagatgtgcacaatcagatctccctggccaatgacagcagctccactacaccactgcatctttatgctgcaaaaaagtaggtcagagggatgctcccttatatcataagaacacagatttactgagcattaaggatgctgttagataatattatagtttatgaagcaaatttataaattgatatgatgtaaaacagcaccttcctcaatgggtaattttgcaagagaggcacgcagcacacaacctttggacaaagccttcttgggtctggatctcccttggccctgctagcagggtttgcccacagcctctccttggtaccaatccctgttaaattaccccatccatttgttatgcttcagaaatcctcgcaaaaagggctgctgtacagacatgttgtcatctctaggcatccataactgtgacaagtgaaaaggtcatgccttcaaacattagcattgcaaagaagccatggtaatgattcattttttcctttccaccattactttaaagggctgaaaatacttgagctggataggagaacatgggctagtcagagcatttctctctaagtgctgaatttaataaccagaacaaaaatacccattttagtagggcactctttcaaagtagaaatctaaataaaactgaggagtattgtgtgcagattaagatgggcaagtcataaacaaaccagaggtctatggtttggccaaggtacttctctcatcaaatgcgataaaacttgtgattatttttttaaaaaaggaaaagagaagaaaacaaacaagtcctcaaaacaatgctgcagtttttggagaacagttcttccagttggtggttttaaagtactagggaattacattctgggtcaacaccagccttggagctcctagaataggacagaaacccttacttcagaattggcttgctctcattggaatatagtcagtgagtgttaaactaccctggatttgggaggtgatgatggtgacttaccaagttctcaaaggaaaactgtctgtttttatgtcttaccattttatacatttcctttttacaaacactgcaaaataggaaatcctgaccatagccttgagatgcccaggagactgggaggcattaaacatggattgattttcagttttgcaacaagagtttctatattttattctaaggatgagggtgttgcaggaatcaggacactcatcaggaattggggcgtgggggttgatggtagtggacaggggtcacctttcaaagctaaattatatgtgggtgtcatggtttctgattcacattccccagtcgtgagagaaagaatgaggagtaaatattttcttgttcataggcctgtaatttatttattcacagttttgtaatttaggttacttttgttggctttgagatctctaattatcttgagttagcctctttcccgtatgagaaaaaatcttgattagtggattgaggccaaacagaaagtgccaccaccttcagttcctctgtgatggcagatccatggtgagcctggggtttctacagccagtaagcctccagctgtcgaggaacatgccagctcacctttttataggtgcacccaatctctactctttgagttcccctgttgaattcaaatggttgaacttaaattgttgaactcaaatggttgaaagggaatgttcttgttccctcaccataaatgctgaatcttaacacctcctcttattccctcttctctctccaatctccggccacaagagtgcaaaatggtgctgccacttggtcaaacagtgtggcagtttctcaaaatgttaaacatgaaattgccatataacccagtagttccacttctaggaatctctcctggaaaaaaatgaaaacatttgttcacacaacagcttatacaggaatatttatagtataattactcataatagccccaaagtagaaacaaccccagtgtgcatcagtgggtgagtggatttaaaaaaatgcagtatatccgtgtgctgcaatatcatttagcaataaaaaggaacaaagtactgtgctatgacatggatgaaccttgacaacattatgcttagtgaaaaaaatccagaaagctagatactaaagaatacatgctatatgattccatttataaaaaatgatctaaaaaggtaatacgggtattgtgttagtctgttcttttaaagacataccagagactgggtaatttataaaggaaggaggcttaactgagtcacagtcctatgcgactagggaagcctcaggaaacttacaatcatggtgaaaggggaagcaaacatatgcttcttcacatggcggcaggaaggggaagtgcagagtaaagggcggaaagcccctcataaaaccattagctcttgtgagacctcactcactatcacgagaccagcatggaggtaaccacccctatgattcaattatctcccaccaggcctctcccatgacactatgggagacgaattgtatttatggaaactacaattcaagatgagagttgggtggggacacagccaaaccatatcagggagagaaggtagattagtgattgcttagaacttgagggggaaaagagaaatgactgcaaatgggcaggagaaatcttttggggtaatgtaaatgctttaagatttgattcagtgatgattatacaactgtgtatatttgtatacaggttataatggtatatatgtatatgtactggataatataaatatatttgtaatgggttgaatagtatccccaaaaattaatgtccccttagaaccttggaatatgaccttatatggaaatagagtctttgcaaatataattcgttaagaagagatcatactgcattagggtaggtcctaaatccagtgactggtatcctcataagaagtccatgtgaaaagacacagaaacattcaaagaagaatgtaaattatgtgaagataaggcagaagctgaagttttgccgccacaagccaaggaatgcctggggccaccagaagctggaagaggcaaggaagggtcttcctctagagctcttagagggagcatggctctgttgtcgacttgattttggaattccagcctccagaactgtgagagaagaaatttctgttattataagccacatagattctagtaatttgttacaggcactctaggaagcgaatgcaatattaagtgtacaactgaattgcacacttaaaacaggtgaattttatggtatggatattataccacaataaagctattaataaaaataaacatttttatttattttataggctaggggaagggggggatcagaaccaaaggctggggacagtacagccagttttgctgcatctcagaaatgccagaaaaggaatttcacaacagttgtgagcaactgtccttgatatgcaggactcttggcacctctttcttgagtcaccaatttgcctactttccatcttattacacggtcagtgctgtggggcacatctctgccacatggctgctgactctagagaaactcccaaatgtaggttcttctgtgggtgttcaggctacggaactggtagtattttgacgtttcattatatgtctcaaacctctctagtaagccatgggaaaagacatgacccagtatgtgccagtcttagaagaagccacagtgtttctatggtcaagtaccttggaagtcttacgaggcaagcaatcaagtacgtagtctgagcttgacctcagaaatgggggaagggagcttcttcctgtgattggggaaatgagataaaaagcaaataaaaaggttgttatgttttgatgaattttcaaacctttctagtcctttttgttaacatcttgttcctttatcatatttttaaaatatctttaaacattcttgcatagttattttgcagtctgtatctgacaactgtatcatctgaagtcctgggaggctggttctcaatcatggtgttagttttctcatgtgttctttagtttcagtttgtgagctcacggccagcagggctttatctgggtgcatttcagtgggcctggacagaggacacattcttctagagtatgttagcttttgctaggctcctcaggccattatcaaattacggtcaccttcatgttaaagctttagcatgaatttgactacagacctatgtagagtcaggccagttttataaattctcaggggagagattgtttttctacatatataacacaagctgaggcagctttcttctctctttgcctttgtggatttttatttattgttattattattttggttatatactttctgtcaagatagaaccctttgaggagcctggctttggaggtctcatatttaatgtcatgcctctcaggtagtcaaagcaccgccattatatattacctctggcttttcactatcagcttttgtgtttggtctctggtttttctctcactttctgataagcttagtatgcattttaaaaggtgtttgtcatatgcagtctacaatttataagtggcttgtggaattggggtgggatcttttgtcatctattgccaagaaaagaagtctatgtattagacttcttttaattttgatgtgggaaaaggaaacttgagaagcttcacaaataaagggttcccttttctcagtaaattggagacgagattctctgctataagttatggaagaaggacaggtttgaggtctccagtgactgataaaggtttgcaaggtttataacaactgtgggagatgggcattgtgaaaagtggttacaaggactggttagcagcaacaagggattcacctaaagttgactaaaagtggaagttttatccccattgtttataatgatagttagaaaccagtaacatcattgtattagtccgttttcatgctgctgatacagacatgcctgagactgggctgtttacaaaagaaagaggtttaatggacttacagttccatgtggctggggaggcctcatgaccatgatggaaggcgaggaggagcaagtcacatcctacatggttggcagcaggcaaagagagagcacttgtgcagagaaaatcccatttttaaaaccatcagatctcataagacttactcactatcatgagaacagcatgggaaagatccgcctccatgactcaattaccccccaccaggttcctcccatgaaacatgggaatgaattatgggcatacaattccagatgagatttgggtggggacacagccaacccatatcaatcattctgggtgtgctaagggacataggccatagccctcaacagggttggaagagcaacgtgccgtggatatgaaacggcatggcaatttctgctgagggctcacttactcaagtttcatttttctggtgcctttcctttattttgctcgagattctcatgcagcagtttcttgaataaatttcattttgaagaaatatctcttgaagcatggtttacctgagtgttttgccagggaaaatcaagaaccctgctttgctgaacaagttgtgtcccttttgctttttcagttcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcaggtaaaagcatggcaaatacaacacaatggaatgaactttattggaagaataagtctttcctttcacagaagcgggtgcagataagtagcagataatctttcggaatttatttacgaagcactatttctctcccctttcacacagcgagattagtgaagtagccttcaaaaatagtgcttcagcctaagtgttattaagaatagggttattatgaacgcagcagggaacccaaatgtagtaaaaaaaaaaaaaaaaagtgagaaataaggtttttaaatgacagttaatccttcaggaatgatggcctatgctgtgtgcatgttttaacttcctgcaaaaagaaaaatgagatgggctttgggacaaaaatattatcataaaaactatcttgcttctttggaaaaatccacaataaaaaaaaaatctgtcgttaaaagaggatcacaaaagctagagaaaaggactgtgagcagtgaactggtttgtgctgttgtcatgcggttggaggatgatactgtagcacacacagggtggggaggtggggaagccctgtgtttgaaatgcttatattggctctcagacaagggtccattcctggaatcctcctagaaaaggaatctgatgcgagtcttgcgggcccccagccctgcctgcagtatttaatctgtctctttaggcatggttgctttggataccatgaaaaaaaaaatgtatatgtgggatatatgtcaagctgaccacgacatcttatataaattacacatccaatttaatgagctacacctgacatggataatgtacgtgaatcctatccatccgcctactttcaattacactgaaataatttgtcctcagagggatacgtgcatgtgtgtgatttagtatgtgagtctggaggaatgggggttttgtgagtgtgtgtgtgtgtgtgtgagtgtacctatgtgtgtgcttggcatggcaggagaactgaaagagtggagagagagagctttacggctcaaagtcattttgcctactgaaaaagatgaatttctttctgctttacacatagattttgccaactgtgagagaagattctggtttcttttcctgccatgctattaattcttatggggaggaccgtggaataattcagctcacagtgcaaggtaggaagacgatagcgtaagagaataaacacagtcatttcaggatgggagctgtatgctcagcctcaggcatctctgtgtcctcaacttgccatgtaacacttcctaattcccaggaaattttgaatatgtataatgtcagtgctaaagcagaattttgcagtgcctgggattatgtcaaagtaaagcccccaaacagggaacgaagcccttagaggaaccagtcaagatgacaagcccatgacagtcaagccacatgcacacaagtacagcggtggaatttctttgctcaattttaggaatccatgtactagatgaccagaatgaaagggaagtttaacatttggggccaaaatatgttttgagttagagatccaaactagaatcgtgacattttatatcctccaggcttggtccagttcttaagggctatgaaaattggaagtcttgggaaagtggaatttctcttccctaaaatgtgattaggaaaaagaaaatgcttccaaataaaaagcttctgttcttgtctaatgcagacaaatcgtttgtgagtcacgctcagcatttccactagcgttttatgtcagagctctgtttgaactaactcgtagtctttctgttgatggcacagagcccccagaccctcccgaaattgagatcaaagatgtcaaagcacgcacaattacgctcaggtggaccatggggtttgatggaaacagtcccatcacaggctacgatattgaatgcaaaaataaatcaggtaagttctttacttcctccagcttcccttccacctcagaaagttcttttatttttctccttattaatgtgttttacctgtaagcgcacagctcagctcacaggagctcagagggcaccacttcccccagtctccttgctggaagcacatcctggctttctgctgtgggagtggagtttcgtgttgaggctcagctctgcttctttcttttttagccagcccagacttcagtcttgcttcctgctggactccttgatattgcagcttcctgttggcatgtgggcagtggctgatggagacaggcccccaccatgaccttttctatttcacctgctcccttcacttcccgtttcccgagctgggtgacttttgtagagcctgagcccatgtcctgcacccagagcgttgagctcaagctgtgcttggtgttggtcggataaactgtgcagtggtggttggtgcagaaaaaggaaaattcactctggagcaacctcctggaaatgctcagggaccatcggcgacactggctgctgcacccaggaccactcggcccagagcccataaataaaactgaccctgctgccagggccgctgcaggtgtgcccattcattgccttcaaggaacaatgcccgggccattttgaactttatgatgcattgggcgagggtagaataccaccacagtggcctctagtcagaatttttactgtgtctcataaaagatatgaggaattcgagcaccaccagcatgggaagggttaataaaatccttctaggccgcaaaagcagctttatttttcacttcctggataccgcacgttatttcagattacccagttgtgacccatctaatatctttggcactaaagctgtagtaaaaaatcaagctcaaggcagctgggaaccacaggtcaggagtgaggaaatgtttcagcaagagcaagccaggaacagagccaggaaatggtgactgcaaaggcaagccgaggggtgactcttcgggaattcaggagaacagaatttgaagattgagaagatatggatcaaaacaaaaaatagtgttttgaaaagtagtatctgtgactgctgggttggaaatgcacatgaggaaagatggaatggctcaggtcatcggcctctgagttgcaactgggggcctagaagtgaggtgtcacttacacaaagtctgaggaagggccttccggggttgattggactgcaagtctcaccgtagccaagaaatgctgcagagccagggccctgggctcaggggtgaggcacagtgacctggggggctcacccaagacagtgctgagctgaacaagcatcttttggggactaggaccaacaggtttcccaagggcccagggaggagaggctgaccttgcctttcttacaagttcatgtatacaggtcttgaagtgaagcaaatgcttcttaggtgaggcaggcacatttgagcagaaactgtcctggaacttagtgacagtgatgagagctcagacagatgcagtgagcaccgtggggacagggacagccctttatctcactggctgcgcactggctatggggctgcaggctgcccatgctgttggtgcgggagcacacaggagacctctcctactggagcagcccaggacctcccctgtcctcatggaggagcgggcattgccggatgctggtggcaggcctgggctcagtgatttgggacccagcctgtgtgggattcgctgctgggcctgcgttgcaccagctctgcaccctcgcttgcgcatctcacctgtgaagtgggcactgctgcatccacctcaaaggactggcaaggagaccacaaaggccaccagctgccctctgcctggagtcctcccttccctgagccacccagttactaccccctccatagatctcaattctcaggtgctcacccagctccttctccctttcaatctgggcaggtggcattatgggtcactatatatgtatctctatgattactgacaaatatgctgattaatgcatttcacctccaccacgctagaggctccttgggggctccctgcacctagtaggtctattttcacccagctcatttctccaacacccagcaccgcacccaacatgtggagacactcaatggaaattggtgaactctaagaagggaagacattgaaaacgccttcctcgttgtctggagcatactcaacatctaataggtggtagcttgtagattgctccagcatgcaggaaaatacttaggagtaaaatgcctctaaaaccctctgtgttaaactacttactcagcatctaagtgtcctcactatctccctactcttacccaggagtttcccaaaggcagggactctggttctctgtgtcctgggatccccagcacccagcacaatgtcaagtgaagagcatactgtaaatgtttattgcattaatttacatgcaattgaaatctaagaatcattattatcaacagcatctttaaatgtataaattgatcatggtttatataaccaaagcaggaaagctccttgtctataaagctgagtacaggcgggattgagggatactcttttccatccttcatgccctacttcaaccagagacagggccagtggtgtggctaagatgtttatgtagccctggagcaagtcattttaaggggcagcatgggtcccaggagaaaagcccacaggacaagcagatccaagtccatgaccaaggtctctaccaggaccctacagaacttcaattactttcagtttggaagccctgggaggaaggagctgtgctgagagtagatagcacctgtactcactgctgtacgagttgtgttagtcagatttttcatgtattagtttcttcctccagaaatttttggtgtataaaaattacaaccataatttaagtgagtgtagttttagactgagtacatagaaaactgatccttcaagtattaataacagcctaaatgtcacttcttccaggaagccttccctgactacctattccccttcactattcatagcatgtcttggaacacttggtgggcttgtgactattaatttactatctgcaccccactgaacagttgtccccctatgggccatagtgagccctgagggctggaattgtctctgacaaaccttatgctatgtccctgtgcccctcatagtgcctgacatgtatacgagactcataataaccattagtcaaattgttgactctcaacatctgttttaggcaacggtgaaattatccccccaaaagttttcctttccttttcattaattttcaaagaaagcagcatataaccaatgtattaaagtacttcacattcgtaacagaaagaacttctgcaagtgaccattcactctatgcttgaacaatccgagaaacagaaactcactaacccagggagcacagctctgcctttggccagctgtgactgctacaagttcttacatttattgcaccaaaatagaccttcctggatccagtgtctctcctcccacctcttaaccctttggccaaatgacagtcctcccaggatttgacaacagatgactttccttggtttactcttttccaggaaacactgaacaccccaagtccttgttattgtatctcctgtcatcatctcctgcccccctaactctggtcatgcccagtggcagcaccagaggcgtcatctgagcgggcacaggcacagtgaagctgtcccttccttatctggaacattcttcttctcccataggtggcaattacacaggttgccttggttgccatattttctgattcccagggactactgcttctcccctacaaggacccaaggccacctttaacatcccttcgagcatattgtctggggacctccagcagattcgtctgcagtttgttgcctccctttattcccttccttggaaggcagcctgcccttcagagtctgttcctgtgggggccatctcctgtccgcaggttctcttgttgcctctcctgtccacggtttctctggtaaccccccccgtccacggtttctctggtagccccctcctgtccacggtttctctggtagccccctcctgtccacggtttctctggtggcccgttctgtccacggtttctctggtaaccccccccgtccacggtttctctggtaaccccctcctgtccacggtttctctggtggcccgttctgtccacggtttctctggtaaccccccccgtccacggtttctctggtagccccctcctgtccacggtttctctggtggcccgttctgtccacggtttctctggtaaccccccccgtccacggtttctctggtacccccctcctgtccacggtttctctggtacccccccccgtccacggtttctctggtagcccccccgtccacggtttctctggtaacccccccccgtccacggtttctctggtaacccccccctgtccacggtttctctggtaaccccctcctgtccacggtttctctggtggcccgttctgtccacggtttctctgctggcccctcctgtccacagtttctctggtacctccctcctgtccacggtttctctgttggcctctgctgtccacagtttctccggtgcctccgtcctgtccacagtttctcttgtccctccctcctgtccgtggtggctcacaggtctctgaccaggtttcagcaccatggcaagctctgtcacaccctgaaaggtaaccaggaaacacagactctgacacagaaggtgcacaccccaacccctctcctctcttggtcttcccacccctagttcaccctgaggactgttatccttgagaagaataagacagagaacaaggggctctcctgtgtccccacacctcctcctattcaccaacatgaagggcccgctccctctcccagctacctctccattgttaaacctttcatgtaattcacctccagaactttcagtcaccttcactcattctggtctttagcctctaacagcacttcttcataccaagtccactctcttatattagtccttgttgctcttgcatccactggatttggggtatctgacccccaaggcgagctccccagcaagcacccagcgcagtctcactggctcctgtcagctcttcactccttcctcacctcacagaggctgcagtgggactctgaactgccccatcctcctacaccaccagtctccctggagcaagccatggcatcccgcccactctttcgtgaatgcttctgacatcttcctaaaccaggctgcaactccgagcctatacagccctctcagtcttcctacaaacccacagatggtacagtcattcttggccaaagttttcttctcttacatttgaccaaacgatttctgtgcattgtcaagtcaataatttgccagaaggtcttcttctaggcatacgagattttcagcaggtgcccggaaatatcaaaatcctgtcttattaggtgttttcagagagtatgtggaggtcatgcattacagaaaaatgaccttgaacttggagataacacaggcgaggccaaatcccagcccttcttgttaccagctatgtaacagggcttgagtttcttgactttcactaaggaaataaaaaccttaccttgacaggatgttgtacaattttaatcaaatgaagcagtctgtccaaactatacatcggaatgaccaagatagggagcctttttaaaagcacaggtttctgggcaccattccccagagactctggtttggtaggtctgaaagcagaattatcaaaaagccccaaggtgtttccaatgtgcccacagatttggggccacagaagtcacgtttgaaaatgcccagcacattgacctgatgggaggaggaaactgaaaattgagatataaatataactaggaagaatgcaccattgacccaataaaaaagttcttaggcgtaaaacacaaacagaaatgtatgcatggacatccaagatctgaaaagtggcaagtgtgactggggagagtctgggaaggccacggacaggagggtgaggatgggctttgtaacgggtcccccagcccattggagggagttagtggtagttgctacagacagggtgcaaacgcagcatcagagaggatttataagtcacactgggagactgttgaacaaggtgacatcactgagataggggctgagctaaaggaacctatagggcatggatgtggaggtgcccagtgaccaccaagaggggactgtccccaccctacccaggtccaccatatgccttggattggtgtaagggactgcagtcatggacactcatatgcctctccaggctgcctgccaactcccagacaagagcctccagtgaagatggctgtatcttcattggccccgtcagtttcagaaacttcaatgttgcctgggcagaggcatcaaccaccacaactgcctacttcctccaggggctacttagcaaatgtctctgcatcttgtggcacctggcattcctcctcatcctcctaaacatctctgcagaaggtctggctttctctctgtgggacaagcctcataggtgtgtgccgtttcattgatataaaatttcctctcctcatttgtcttccattgaatcccattcttccccttgtcaatttttttccaactctttgtatttcatgtttttccacctctaatcttcttgaccccaaatatgctttttccttctaactgcaatattcattgtcagattctattaggcttcattctctgagaagttacagtatccaaaagcagtctttaagccacatattttttcttcaattccagaaaatctcttgcatttatgtttaactctggacagagaagtcccctaaactgccatactcacccttagtgtgacaaagtgattggccccattcccaagactcagaggtccatgtatttgtggtttatttgttcctctattaaacattcatgtactatttgtctactatgagccaggcactgtgctagcactagggataaaagactgggtatggccagcatggcctctgccctcctggagcttaaagtctagcagggaacacagattcagattatccatggaagacttacttgtgtggtgagcaccaccaaggcagaccctgaggagggtgggaatatgtaggcaccatctctgtctactgtcttgggccctccttttttcatccccagccaataccagctgtcgaccacacacctacagtcaacaactgcccaaactcttttgatataagaaccacgtattgacattctcatccttgcttgaagcctgaaaaccaccagatacaaaatgtcacagattcagtgataacatttcacacaaagtaggtgctgctgttataattagctgtggttgaaaaataattcctacaaccaaggatttggcactaaatgatttcaaaaaatagaactgaaaaaatatgtttggtaatcaggatttattctggaacttgagattggtttgtatgggattatcttgtttttaccacactctatttggggaggaaaggatctgatatggcttgaagttttgctggttttcaaatgccagggattttgggggggcccaggggtactatccaaaccatagttcattgtactgtcctatacaatgagtgcttacagtggccatcgtccattccactaacctgagcttccaccactggaatttgccttctgagatctcccccagtcggctgatctgtgcttcctccatcacccctccctgaactcagctggcttgttgccccatgtccctcgcagcgtgaataatgtgtgtgggatgtcacatcccctctgatggccaactctgccagaaagctgggaacattgcattcagaaatcactttgagtgtaatttttctttctttccgtctttttttttttttttttttttttttggtttttaattcctacttgtgaactttcaaaggcagaggaaaaaaactcacgtctctatctcttcttttttgaaaaacaaaacccaaaagactcctgggattctgctcagagaaccaaagatgtttcccctcagctgaactcggccaccatcattgatatccacccttcctccacctacagcatccgcatgtacgccaagaaccggattggcaagagcgagcccagcaacgagctcaccatcacggcggacgaggcaggtacgtgggaccgggcggaaccttgctccagaggagcccgggagctaactcttgagggctcagatgcttaaatgcagaagcagacctttgcccgtgctaggcggaggtctttgatgcgtgctctccgtagttctgtgccctataaaaaacgcagacagcgctctgcatcttactttgaaggcactgctcttcaaataggatttagttcaagtttcccatacccaagacttaaaagaaagacgtatgaggctaacaatctggtgagattcaaagaatcatgccgttttacaattcctttgtttggacacatggaatccaggttgacaggagaaccgtgagtgtgtttctttcctgagaccctgtgaagtccagtgtgggaggaagcagtaatgcttaactaggaatctgcaagcatgcttactgtgcgggagatgtgggaaggggaacagattattttattgactagaaacatcaatatttaaaaataatgtttttgctcttttttctattacaaacaacattatatttagtgttgcaaattcagaagatagagataagcattgtggagaaggcaaaacagcttccatcattttcccactgagagctaacccaggaacaggcagtgataactggctaaataatttcatcacccacacacgcacatgcacacaggcacgcaccagtgtattcacaccccttaacacactgcgagccactcatgtttccgggggggtgaaattaacaggtgtgcagagaactgagcaatcaggcaatggtccatgaatgctgattgtcagcccgcctcctggcaggaggagaggaagccactgcgcttgggtttcatccacaaggattgcatgcctggcccatttattgtagggaaagggtgtccagctcccaaacctacctcttcttttcctgcccaccatcagagcaatcagccactccctactgcagggaagatggcagcttagtctcaagtccctgtttctccatcaccaagattaaggtgattgccacacccagatggctaacagaagaccggaggtttgttgcaactttcaagagaggttgatcttggcttccttcccaccacctcatctctgctaccctcattaacagcatcccaaatataaatggagcttatgtatctcttaagtacttttctacaatttgtaatgatatctctcactatgtgtttaacaaatctcatattgccaaacgggtcaattattttcgagttttcattagtataaacaccactacaatgaacatcctggtggtatgtcttttgctatctccaagatcattttcttagattaaatcctaagaagtcagatggctggatcaatcaaatgcaacattttcacccttctgatatctgtaatcagtgttgtcttcaagagaataggttaaaatgtacaactcttcctgaactgcagaggaatgcccatttttcaatgctggaagatgtcagttcttgaaaattgttttcaagagtgagtgacagaagatctttaggctgaagtgcctgagagtgagccatttctgagacttggattctctgtatgatttctcatctgcaaaatggacattatgatgcctttctgctccttacacagacatatctgatcactgaaaaaaactcaagctctgaaaatactttgcatgtctcagaaataagtgggaaataagtgttaatctgcttctgcaaaaaatagaattgtatttaattatgtatgtaaacaacccactaacttcctcagatccctgagatttcattatgctgggtacttagggagaataagctgtccccatccttcagcccaaaatgtcatctctgacttcctgctcaatcttctccttctctctcaagcccttttctaatctcgccccatcccagccacctcctcgggaaaacagcatttttccggtggtgcattttgcacctgcttttctgattgccattattaatgctgctgttgttgcttttttcttcgtttcctctgtgacctctgctgcggctggcagttgccatggaagcagctctctccctgccagaaggccaggtgaagagcctctggggtgctggtctgcagggcagctgcctggcatgtctgcagacagatgcagatgctgcctctttggctcccaggctggccttttgtattgtatctgggtgtgctggctgtggcagccccacacagcccctctcctttaatattcagaggagctaaggggaagggaaggaaaggagcaggttctagaaatgaaaagctacagcagataacttgtctttgtcttggttcataggtttgcatgactgaaattaaaaagtcaatttcccatgtgtgacttacctagaatggggtgctctggccaaaggcatcctcattagagtattgagcaggggctgtagacactgctgccccttcccagcaggtaaacccaaaggcacatctttttaggagctgtagctgtcttgaggtgaccttgtcccactgttcccttattcctcatatgggagcctccggaagctgtcagcccactcacttttactgtaatctagtacccaagtcttgggcacacgaggatgccccccaatgctactactttgcaatgacacttagtgactccccagagcccaatgcccagcactcacctgcctttgcatgctcccagacccctattgttgtgcttcttcccctgtcttgaaggcactacaagttccatgtctccttttctgtgcccttccttgaaaagtcaagttcaagaatgccttcctccctggtgcaatgcctttttccatctcccatgtgtagttagggactactcagctcaggacagaggagggattttgctgacagtagcctttgaggtgtatcatcatgtcttcatggaccctgctgtccatgatgatataccacctgatgtggaggggctgtggccccctccacatcagggggcatatgtgcttacaattctgtcccttgtgtgtgtctggcataagggagatgaaagtatgagatgaacgtttataaacattacccacagtattgcctttagaatgggtgtcacaatgagcagagtatgtgtgtgtgcgtgtgtgtgtgtgtgcgtgtgtgtgtgtgtgtgtgtgtgtgtgtatgtgtgtgttgagaaaatatatgctggattaaacccacagtgaaattctgaagggtgccctggtctgaatgttcatgccttccctttcaaatgaatatcctgaaacctaattcctaatgcaataatattaagaagtggggcctttaggaagtgagggtggacccatcattaatagcatcagtatgcccttatacaataggcccaaggcccaataagatcacttaccccttctgccccgggaggacatgggaagaaggcactatctatgaaccagaagaatgagccctgaccagacaccaaatctggcatcttgatcttggaattgtcagcctctagaaataaatttctgtaagaaataaacttctgagccaggcacggtagttcacgcctataatcccaacactttgggaggctgaggcagggggatcacttgaggtcaggagttcgagaccagcctggccgacatggctaaactccgtctctactaaaaatacaaaaaaaaattagccatgcattgtggcacatgcctgtaatcccagctacttgggaggctgagacaggagaatcgcttgaaccctggaggcggaggttgcagtgagccaaggtcgtgccactgcactccagcctgggcaacagagtgagactccttgtcaaaaaaagaaacagaaataaataaacttctgtggtgtataagtcatgcagtttagagtactttgttatagcagccccaaaagactaagacaaggacttcatgcagaaaagtagagaaaggtgaaagataggacaggaaggctgagaggaaagaagatggggaaagaatacagcccccatcagagctccagtgaccacccatgaaatggctgcatctggagcttgaggtgccctccccgcatcctgatggaatagggcatgtcccaggccataagctgcagcccacgacagaccaggcctgtggatgtgagtcggctcagtgttgtgcgaaacttttaaattcgatgttaatttttaaaatctggaaatttcagctgaaaatctaaattttgagttcctcttgagttcctgcttggcagcaatgagctggagttaagcatggagtggccatcccagaggctgaccataccccctcagtgagccatagttcccatcctccattcattgaaggatcagcaaactacagtcggtgagccaaacttcacctacagaccttgaactaagcatagttttttcatctttaaaaaaaaaaaaaaagaataacatgggcccataaagcccaaaatttgtactatctgagtctttacagaaatgtttatggatctctgatgaagtctggccaccatgggaatttgagttttagatttctgctgtatctactgcaaagcttagtgaggaagggattgctgccactggcatagtgtccctacctaatgttgggaaatctcattgctccaaccccaaactactcagtttatttgcatgtgttgcatgtgaaagtgcataaagcgttatcataccactttaatacactcgacctcagagaatagccatgaagccaagaccacaccattcagcgcagtcttcatggcttccccaaccacccctagcaccagcagcccccacaacaaaggagcagtcaagagaataagtgacacagtcggagttaatgagatgagctgttaatggacccgaagtgtgtctctttgacacggatcagccacgtgacacatgacattcacagctaacccttgctacagaccaacttccccattagcagctgccccctgcaggtcatgagtcacttagtgccttgtgaccgagtttgggatggctgcccccttcattattttcactataaatctgtgcatagaacatgcagcttcaattagtgggtgctcattgaaacaccactgaatttgacagaccatcagagaatagaaggtgtggattatggaagggtcatgatgcagagtcactgggtttccaatgaatctggcactgagttaagtccttgcctcatctttcctcccattccggggcagcagctgtgatctggaagaagagtttcctatgtgctgagctggggtggaggggagaggatggaatgagggcagaaggaataaaagtcaggagcatgtgaagcaaacacagggctagcagtgctcattagtgcagagggcggcatcaatgtgttcttcagtaagagtcaaatgcacagcattcactcagcgagaagagccgagcacaccccatgaccaaccaggccctcagcgatctgcctctgtagatttttgtcattctcctccatcctgggtttgaagaaactttgggaattaaatctaaagaaagttatcggccttcttgctgtccctcatacacattgtgtatacccctgtctgctatcctgaaaggttctggaacagttctggaatgttctgaaatgttcttcgtctcttcccttaccactttcaaatattattctccaagaatccaatcctggccaccctattaaaattcaacccactgcccactccactgggtcccctgcctcccttaccactctccttctagcagtcgcttgtatcagcacccagtgtactgtataagttgttgatttattttgcttatggtctgctttgatcccatcccaccagggcaggtggagttgcttgttctgctcactcactgctgtatcccaggcacctagattggtgtttagcacataggatgtgctaattaaataagtaggttaaataaatcagccatttatttaataagtagttattacatgacttcagcctttccccatctgggcaccagctattctttgtcgtattttgatttttactaaatactgtcttggttccctttgtccaacacagagcatgcctctcgcccacccacccaactcctgtagaagacaaacgtgtgtttgtagaattatgcagctgctcctcactactttttaaaaatttatatatttttttctgcttttgtatcccagtctttgcctagtttaggacctggcacatagaaggcaaatctcccaatcagaaccagaggcaaaaatgtgggactggttctcactggggtgattgagcccatatcaattaatgatgaggccccaagatgctggctaaagccaagatattgagacagggaggagagtattttggagcagaatggagcaccgaggcttgagtctcagctctgggagggacacaggagctgctgggcagtgggaggttgtccagctggggagggacagaagcagagacagcgtagccaggaaggatcaggacagggaagcaaagcggagatccatgcgtttggcaatcaggaggtgcctgtcatccctgtgttttcagccaaacagaatgaattgtcctgacttttacctttgcaaacataatacaaattataaagatagtcttcgcttattactgctttacagatcgaagagttttggatttcttagaaatgcagagtttattttgtaaaatcacttgttttttgtgagatggagtcttgctctgttgcccagactggagtgcaatggcacaatctcagctcactacaacctccgcctcctgggttcaagcggttatcctgcctcagcctccccagtagctgggattatgggcatgtaccactgcacccagcaaatttgtgtatttttagtagagaccatgtttcaccatgttggcaaggctggtcttgagctcctgacctcaggtcatctgcccactttggcttccaaagtggggaagccaattctgctttttctatatattacatttgaaaccatgtaagtaaattcttaaatttccaatgtcaacacaattttcaaatttagttaaataaatggatatacctaatttttgacccttaatacattttgcattggaaactcaatcggctttggactgtaattttataggcatcattggcaatgagatgataacctatgaaaaaattacagctcaggagttatacagaaagcaataaaattcttaaagaagggaaattttttataatttaaaaaatttttaaagtaatgttttagaaacatagtagaaaatttagtgccctttgtaaaacacaagcaaacaaaaaaccttcctaatgatattggacatagccctattgtgtgtttgtacaaattaaattattttggtttgtctggactgttttcatcactttttttttttttttaggaggagggatccaaatgctttcacttcagggaacaggcagaacaataaatacattactgacaaatcatggcagcattggtaggctaagtaataaagctgttacattcttaaaaacagttaagtctgtcctggatacaagaactgtaccccctctcctcttcagtggggaccttcataaaataccagacctgggcctggcatggtggctcacacctgtaatcccagcactttgggaggctgaggcgggcggatcacttgaggccaggagttcgagaccagcctgggcaacatggcgaaaccccatctctactaaaaatgcaaaagtcagccaggcgtggtggcacacacctgtaatcccaactacttgggagattgaagcaggagaatagcttgaacctgggcggtagaggttgcagtgagtcgagatagtgccactgcattctagcctgggcgacagagtgagaccctgtctcaagaaaaataaaataaataccagaccagattggaaaagtaagttactcccaattcatgattacattatgatatgtatgctatctgatagaattggggacattcttgtaaacactatgctggcacctttggtttaattatgaatatatctcaactggaaaatcaaggttgcaactcttgtgtgccatcttcctgagaggaccacaccaaaggccatgccccagggagcccagaggattcaggatgagacagtgctcctgacattgcctccaattcctaacaaactggcttcttgtcaaattcagttaagtgtaactaaattaaagtaacccagcctcagtatagctgtcagactcaaaaatcatttttcaaggatttttatggaaaaccgtgtgcttttcaatgagcacagaattatctgtgtgtgagggaaatccattccatgagtttttattgaatttgaggtccaaagtttcctgcctaagagcttgaccccatgtgcaagaaattgggtgcagaggctcaacaataatcatcaccattagctggaagccattctctccctcggctcctgttctggactttaacttcagttctagcagagcctttgcatttttggaactaatagatctgagaggctgtagcactccagactgccagctgtccctggacctgctgaggagagggatgcatgctcagcatttcagcatctacaaattgctttacccattcaaagcaaggactcactctgggcttagttcctggtgccatgtagagtctgctgggtgaccagagacatgcaaagacagacacgcaaacatatatgcacactacagggacaggtccccaggcctaggcaggtgtcagctgcagcgggaggctcacaggcatgggcggcaaaccctgatggagggagaagaaagccccagggaaaaggctcggctctacccaggggtcccgtgtgttttggacatggctgggacacagggtgcatagggagtgcgcggaacgaaagcgtggagaggacggcgaggtgccttctgggagcagaaaattactagggtgggtgaacagtgtgaattgtgctctggggccatgtcccttttaaaagagtacaatagagaccagaattaatgtttaggaactaaatagaaactgtcaccaggcatagaagtggggtgggagtggggtatcagagtgagagatagggatccccataaggacgatggtggagaaagcataggacaggggccatttggatcagatgtcagggacagcatcagcaagtgtgtgaaggaggggtgcagggaacaaacagcccagagacctaacccccacctcctctctctccagctcttgtcttttaacacctttgttttaattataagtacatcttaactggaaaatcgaggccgcaatgtccccatttcctttcaaactcatatttctaaaccataacaaaccacatatgctggagaatcggcttcgtttcttggcattcttatagtatcattctctcccagtcccgccagccctgacctgcggaatcagcttcctgcttggtcctcagtgcgaggacggagctgtggagtcccattatcctcttggagtagcaatccctgcatcttagagcactgactcctggggaggggcaccttgatagagcgccttagtgccctaagacacagggtgcacccttttctatagaccatagccattttccaagactttgttttgttccaaagcccataactctctccttcatgttcccattctgatttcctgcttggcttattgtcatattgttgagaaaagcaacaatcaggtttcaacccgcttctttcaaccagtaagtttacctgtgtctgccctcacctggcttccctcaaccagtaagcctacctaaggcctcccgtcgctctgccctcctcccatcccagaggtatttgttcctttgccccactcactccatagcctgtatcttctgccctcttcagtttctgccaggacattcattattccttcaagtttaccttttgttgttgttgttaaatttctcccatttgcttccccctatttacaaacacttaatgataattatattatgattatgatttcttatatttactgagcacattgttttcataacaaccctatgatacaaattccattggcccattatatatagagagaaatggagtcacagacaagctaagtaacccgcagaaaaagcacacagccaacaagtgatagaaccagaatgtgaacttggacagaaaaaactcaaatggcccatcaacttagcaactacatcatgctactactcagaacttcctcttcctttataaaaaaggaagggagctttcccttagtcatgcgcttccccaaatctaccctttatctataagatagctttacttttcccattacttccaaactccccaaaatgagttcatatccactacttcagctttcttatctcccgtgtgccatacaaccttttgcaaatgtccacagaactggctttctgtagttctgcagtgatctaaaaattgtcaatccaaaaacattttttaatctaaaggattctttccctctgatctctgtgtcgtcatttgcttctgcttctcagaagacacctgttttcctgctgccttgcattgcaaccttctttcagtgtgtgtatctcatagctctgattacattctgaactcttggttggcaaaatgttttacatctcttagttctacaccatgtacctagtaggtagcacatttccaacacatgcctatcagctctaactgggatgtaattggaattgtctctcattggctccctgtaattgagattgtctctcattggccccctgtaattgggattgtctctcattggcccactgacttattgcacactcagcagaaataggttgctttaaattgcacacttttgtttcctctttaacattgcttcagcactctgtggctagagcccctggttcacaagggtttttttgttgttttttgtttgtttatgttttgagatggagtctcactctgtcgcccaggctggagtgcagtggcgcaatctcggcttactgcaacgtctgcctcctggattcaagcaattctacctcagcctcccgagtagctgggactacaggtgcatgccaccacacccagctaattttttgtattttagtagagatggggtttcatcgtgttagccaggatggtctcaatctcctgatctcgtgattgcccgcgtcggcctcccagagtgctgggattacaggcgtgagccaccgtgcccggccacaagggtttttaattgaagaacaaaagccatgaaagacacccaaaggcagaagaatcttgattatttttgcccgaagtcattctaatcaattgagaaaccccaataccacatcactaagcaaagcttccagcggggagagaaggaccttcaatacacaccatagacagcatttcataagggaaattttgttttgcaactttctgttgtaccccttgttcaaaattgggattgattcacgaggttgtcaaagacatggtgagaaggaataccatgataggtccccaagattcatgtttccaaagagcaaataaacaaaggcctagagttggacacagtaattctacaaaattgacatttcccatgaccgctaaaaacttctttctctgtgccaaacatagggatgggttgtcctcggggaccacctttggctgtgtaggcttcgatctgctccggaaagcgtctctaacctgcctgtgggtttttggtccttacagctcctgatggtccacctcaggaagttcacctggagcctatatcatctcagagcatcagggtcacatggaaggtaaactcagcaaacatttgtattctcggtgctttccccccagggcgagcccttcactcctgttcagtgttatgacaccaagactctcgaattttacaaaacttttattttttcaaaattaagttgaaagcccttttcttaaaatgcagtatttgtatccacattttgaatacttttacagcaaattctgtgtctcagagaataaagtggttgtatcttttttttttttcttccttgaatcttgatcaaggtctaagcagtggtctctacagaaatagtaaaattgatgtccctgactgcatgctctcatttcatcccagcaaaaatgttttcaaattgctttttttaaatggcaaagcatgcggtggcagacagtccaccgaggtggcagaaaacaggccaagtcctcactgtgccactaactagatgtgttctcaagaaagcccctaaattttcttgccagtgaagtgagctgttgaatccactgactcccagggcagtgctaccccatgtgtggcccatagaggcagactggctgctggttactttagtgtttgttggaagtagctgggagagaaagaaagcttgagccacagtgtaaacaattgcatcactaagcacatcgtttcattcaacagccatggtttccatagcaaattttctcaagtaaggaagcagtgttgattctggagcaagctcatcaccaaccaccactgttccatggccttcaggtcagtagcatggccctgacctggtgggccatggcattagtcatcctcctgaatgtgctcttggagatggctctgtcttaggccaaattccgtttcatccagaacgttattatcgaatcaaaagttctgtaacattgcattaactatccccgctctgaatttctctcatggcatgtgattttttttcttgtctctttcctcaccgttttttttctgtggcgtcactgggagaagagggcagccaacaactacaataaggtcttcacatcacacacctcttctaaccattgcatctgtttgtttgtttgattgtttgtttgttttccttctagtatgggttctttcataagatgaccagcctctgtaacaaaaatggattttcattgttggggcggataccacctttggtattacgggcgttaatgcagcgagcccctttgtgtcagcgtttctcaaccgcagccaatgagttgtgtttccagcgggcagcgtgatatgactgtttagctgcatagaaagtgcaggccgaggagtgtgggaggtggtgtcattggtctttgtaagcacatccaccccctgcgagcatcacacacattgtagaataaagacgctcagcaagccataaccccacacgcattcccgccactctacaaatggaatgctgactcactctgtcttgaattgaagactgtgaagttttacccactagctttacacattctctcgtgttttgccctgaaaaagaccaggtattactgtggcctcaaaagctttttggatcttttgggtcctgcatgagagaggtgtctgtccacagaggatctagctcttataactaaaaatggaaacttctgaggctttaaaaggcattgtatcctttctctctctgtagaaagcagccacaaaagtcagtgcattgcagttaaatttctctttagtgccaaagggtgaaatgttgtgggactattaaaaggaagcctggctctcattagattgtgaatcgactgaatacattgttcatggaggagtgcaatctatctctgtagtgggcctttgtggcatggcctgtcagcaggcagacttgccggtgatctaactgactaatgaggttggggctgccctgtcaccagcttagcatttcacatcggcctgtttatataatgagcttttaaaggacaccactgattcaatcgaattggacactattacacgaaatcttaagtatatgtaaaggacaatatgttacatataacatgcctttatttatggcataaaattcagaatatctgttttgtgtaaggagaaagaaagaaggagaaatagcgttagccccaaagagggagccccacatctgtcagccacggtggacatatgcagtcgtgggaagtctaaggtggaagctcattcatggtcacggacactgatcagaagtaaaagatgcattcagtacagagacacagggtaaaggaggaaatagctctggggttttggtgggaaaatagccatttagactctaagcctttgaaaggtaaggggcactttggtggcctttctgtaacactggagatagatattacatttatttaattatcattgaataagcactgcttctgtaatgacaccctctattgatcaaaataagcaactttccacttttatttcattttattttatttatttattttgagacagagtctcactctgtcgcccaggctggagtgcaatgacacgatctttgctcagtgcaacctgtgtctcccgagttcaagcaattctcctgcctcagcctcccaagtagctgggattacaggcatgtgccaccacacccagctactttttttgtatttttaatagagacaggggttttcaccatgttggccaggctggtcttgaactcctgacttcacgtgatccacccaccttggcctcccaaactgctgggattacaggcgtgagctaccacacctggcaccctttttatcttagttatttctttcaccaaagaagagcttctaattttaaaatctttcatgtccagcaaaggttgctcaggacctagtgaatgcagccatcctacatcagctgcagcacctggattcaggccccttatcttgcctcgccttcccagggatacctacccaagcagcagtccacaagtgtcatcgtctctcctgtcagtgttcaggcagtttgtaacatgcttacctctcctgtccattcctgctcatttgaggctcagattgtgcatgactgcccccatgaagatgggaatccccagagtgcaattagagtttcaccctctatgttacccattgctcttggcgatggctcagggaggttcccacccagtggcttctgcagtctgtttcatgtgcatcccctccactgttctgggagctccttggcagcaggaagagaggcttactcagttctgatccctcatggctggcatgtgttccatgaatgaatgaatgggtaagtgaaggagaggtgagtgtatatgtgagctgggaatgaagaggcctagaagacaagtgttccatatcacaattgcctgtgaagcattacgtgtttccaagactgccatggagatggcatccccgctatcaggatctccagagagcaaacatgctgagctcaggtctaactcatgatacagtgaaatgccctagactatacaacggcaggcacccaaagatgtgaaccacactcagtacaccaggcgaccaaccacttttcatatgagtttctactatggtaattttcaatatagtttattgaaaagtaaagggcagtagtggtccaatttgtgataagtttcatgggaaatggacatcttcacatcccaaatataagcccatagaaagatattcaagaggaatatctttctataggctatattatgatgtctatattatgcaagatgaagtctcagaaagggctcttaaatacttttacaaatattaagctaattaaagtgctaccccatgccttgacagaaatccaaaagacaatgtaagcagttctgaataaaattaaaagtaaatgacaataaagtttcatttgacattcttggagaaacaaaaggatttgtgtaagcaaatacaatttaattcatggcaggttttgtttctgattcaaaatcagaaagaatatttaaagctatggataattgataacatatttgatgaagtacctgaacattgtacaactaaggaattctttggtttttcagaaaattccaatttttagtttatctcctaaagtgtctcttttagcagtgcctgtcaccttctctcctaatcagtctcagaatcagctgaccctctttggatgcaaattaaggacaatgtgattaccagctacttgtgtgcatgcttgtgtgtgtgtgtgtgtgtgtgtgtgtgtgtgtgtgtttgccatggtcactcataaaataaaacattcattatttagaatatttaatgattatatacatctcaaaacatttatccagagaatgcaatttaagacagagtttttttcctattgatataaaatttgtgttgttgttttatttttgcattaaataagaaatctttgcagaaccacaggctgtccccaaaatatgaaatggtcaattgcttaaatatttctgtgctgagaacaattatcaaagtgattacttgcaataaaaatcctgagaataattttaccatttggccctcagtattgtactatctgcgtgaaaattttactgagaataagcaaaattctcatttagaattaagaaagagaggtatgatttctgtaaaatactaagttgaatattcagagatttaattaaatttcagtaatctgaagaatatttttaaccagaatatcacatctccactatacccaataattccagctaattgaggcatcattacaacctattaagtttcagagttgagctcttacaacaggaaaatgactcagtctgtcatttaaaaacaaaactgccttatttccagtgacctccgtagtcatcgtttaataaactgcaggctccacttgccttctgcactaaaatccctctaccccagggaagtgcaaggtaccttggaaaaggcagtcttggaggcaccttccagcactagtatttcctggccaactgggacagctgtccttagagatatttgctccccgccaggcacaatgctaaacttctgcatgcattatctcatttgatctgtgagctgggaacacccagttttgtgcagagggagatcctgaagtcaaaggaacttacccaagttctgaaggctggtgactgtcagattgaggacttccacccaggctgcctggttctgcctcctgggtttctgagcagtcaaccagttaattactaggaagtgccaagattgtagttcgtgcataataatgctcaataaatattaactccctttactattccttgcaaactcatgttataaattatacccaaccccataaaaattaaagatatatgaaatttacattcttacgtagtatccttttctttccaaattgtaaacttaagcttagagtaactttcatagtgagtagacacccttttttcctatatcaactgaaattcaaaaaggttgccttgaaataaactttacttaattcttcaactatcactttaatctttaggctatgaaaaatgacaaaagtttgcatttgcttttaggaactaatccattggttctagcattggttttataatagccttattgaaattcctgaacaccaacatgtcttacaaatacttaaagaatttttagcccttctcatattaacgagtctaacctccttccttgataacaagaaaagaaaaaaaaatttcaaaatctctggtcatccgtataaagtaagattgttctttctcaacttttttaggtggactagactctaggttccgtgagggttgaggacatgtcttgtgtgttcactgtaccctcagcaggagtgcaattaatatgcgttaaattaatgcataaaccatttaccattgtttacttttatcataaaaggttcatatcaagaggtggtgcttttaaaaaaaaaactgtggactttctagaaagccctaggtgactaaatttgcatctttttggtgtatatgtaaactatgcatgtttctttaatgaagccatggtgtttatttataccatttggaatgtattctgcatctctccgtctatacattgggttactcctctcggtttagccatgtgatgggccttcttcaaggactccagttctctgtcccaggacagagctgccagcctgcatgcacaaagggtccggcaggtctcctcaactaagcaggcagttcccttggtttccagcctagagcgcagccaggaaaatgctggctgcatttgcaagagctactcgcagccacaggggtggaatctaggtctgatgctcaggcaggctgggaagagacactatctgggactgtcagcctaagaggcaattcttgattcaaaccccactgaaaaagctgtacctctccagcagagtggccttgacaggacacaaattgaacttggactaaggcttaggaccaaggccgtctgccgtcgagccagaaatcctgttggatggtttcttctaagagtttcacgttgagtctggatgaacacaaaaaatctaagtgtaggcactttgattttttgtataacggttaggttataagctgtaaagttgcaatataactttagaaggcaagtattgtatttgcctgatttaaagagcatattatcagaaatgcaaataaggttgcaactaaaggggtattttggacatctattgacgctcatccttaggtgttttcttagtgcatcaacattacatttttacaattggaccaggtcctgaagttgtgacactaggtcaaaaattgtgtatggtcagaatgatattgaaaatgacttaaattgtctaataagcacactatgcataatattcactaggaagctttacagtaacatatatatacaaacatgtaatattcatagtgaaaactgaaaagtacatgtaaaaatataagttgacactatttcatcacattttaaagtaacattagcgtaagttaaatccatttccaacaagtaaattatatataattagaatacagtgtaaaaagtactggattaaatttcagaaaattagatacgacacccatctctacacctaacaaaatgaccttaagtcacttgatttgtcattattggaacttgaacccttttctctagttctgagttgtgtgttttattcattatgtcataaccaagaaagtagcagtgcattttaatgatgaattctcctctctcctcacctcccagtgctgacttgatagccatagaggataacggatgtgggcccactctggaatccataaggtggtcccttgattaacaaccccgatttggatccctatcctagatgctgattccgcccaccccaccaatggctctggacagcactgccatttctgatggcaaatatctcccaataaatgtaaatgtggtgaaattttcccaacaaaaaatagaagtttattttcagtaacctaataatagatggatagggtcgggcacagtggcacatgcctgtaatcccagcattttgggaagccaaggcgggcagatcacttaacatcacgagttcgagaccagcctggccaacatggtgaaaccctatctctattaaaaatacaaaaattagccaggcatgatggatcatgcctatagtcgcagctactcatgaggttgaggcagaataattccttgaacgctaggagacagaggctgcagtgagccaagattgctcaactgtactctagcctgagtggcagagcaagactcgtctcaaaaatttaattaattaatttttaaaaatagatgggtaggtagtaatttaataaaagtattcagaagaccatcttagacagttttatcagttctcatataatcctaactctgcttttcacagagaacaaattggaaaatcaagctaaagttaatatggcattgagcattatgaatgcatggatgccatccgtacagggagtgcataggtggatatacactgtttaatgtgctgtatttcctcagacagcagtccttaagccatctcgctgatgacatttcccatcttttcagagaaatcaagtgagatacataagttagtaaacagggcacagatgttagaatgaaaaaggaaaacatatatccaatcaagaattacatagacatcatcaaatggcatctgctatgtcatggacccctctcctaaggcaagggaagaaacatgacattagttttattgttattattatggcaactcggctggacgaagttggttagggtccatcacaggaagaaccccagccaggagggcacagctattttccagactattttcaaggtagcatgaagcaagacagaaaaacacaatgtgtgccttcaaacgtatttcactagttcaaatacatttaagttaatgcactaagatgtaacaaactatttcaagatagcccataacatttttaaagccaaactcttcattgtattaaaaatgctgaaagctacttcaaattctttcaattcctgtaataaactcttcctgttcttttgaaaaatttaagttgagaccaaaaataaaagtactttgtgctttgagtaattatagatgtataagaaataaaaccattttaccttcttgttttgcctgccagtaacaatttgaagttggaaacagggtttgtttttctgtaaataacagaagaatttaggtggcagatccttagtgaatttaggaaacaagacttcccactgaaggagagtgtgattcagggagtgcctgtgttgctcccgtgggcccgtgtggaatctgtggcacgtgttgcatctggacttgtggagtatttcccctcaacataagccagagtgttcacaggggcccttggtctgaatgcttctagcacattcctaacagggaacatacagtagcctattggacaactgtttcttttctttttttcttttcttttgtttttttgtttttgtttttgttttgagacagggtctcactctaccacccaggctgaatgcagtgtagtggcaccatcctggctcactgcagccttgaccttccaggctcatgtgatcctcctacctcagcctcctgagtagctgggactacaagtgcataccaccatcaccatgcccagttaactttttgatttttgtagagacaaggtctcactatgttgcccaggctggtctcaaattcctgacctgcagcggtcctcctgcctcggcctcctaatgtgctgtgattacaggcatgagccactgtgccttgcccagacaactttttcaatattctcctcgcaaatacctattcatgcatgttgatgtctaaaattctctttagtcaaggctaaagcttttcattacccaaaaatagataagaggctaggcatggtggctcacacctataatcctagcactttcaaaggctgaattgggaggattgcttgagcccacgggtttaagaccagcctgggcaacatagtgagacctcatctctatcaaaagaaaaaaaatagctgggtgtggtggtgtgtgcctgtggtcccagctgctcaggaggctgaagtgggagaatcacttgagcctgggaggtcgaggctgcagtcagctgagatggcatcaatgcactccagcctgggtgacaaggcgagactgtctcaggaaaaaaaaaaaaaagaaaaaagaaaaggaaagagagacaaagcctagctctagagaaagaatgccatcctcctcttaatccctactgagctatagagggcagatattgaatccaggactggagctccattgttactgcagacattactattccttgtcttctgatagaacacaagttagaactatccattggagcatggataaaaggagagtaacgaactctaaccaacactgggcagagcccaggcctttctccaatgctcctttcttagtagtgcctctcctgtcaacctttctcccctctctccttcccaccctgccttggacctgcagcacacccagtaagttctacctcacatgctggttctgtccacagcactgtcctgtacgagtctgcaaactgtttctctaatgggccagagagcagatattttcagctttgtaggccctgcagtctcggtcttaactgctcaattctgctgcataggcacagctgcagtccatgcgtggatgagtgaagacagctgggatccagtaaaacttcacctaggaaaggtgaaatttgaagttcacataattttcacatgacaaaatattcttcctcttttgatttttttcaatcatttaaaaatgtaagccacaacaagaaaccgttgttagctaagagccacataaaaacaagcagccaaacagatctggaggagggaccagtttgtcaacccttatttcctggattgagatgatctctcgagagggagccacatccaactgagagagtctcatctgagacaaggctagcccctcccgccatatatgatatatgctaaatcatcactctccagttcaaagatccacagatctttggggcaggggcacaatccctccaacctctttgctaatgcataacagaagtgacctttgctccagttcccaataagttcctcatctcgtcttagaactcctcagcctggacttctttgcctatatcactaccaccattgtgatcataacaatttaacaagtctctgggaagttccagactttccctcatcttcctgtcttcttctgagccctcaacactcttccaacctcagctcattacccagttccaaagttgcttccatattttcaggtagctttatagcagtgccccactcaaaaatggcttctggttcattggttcttttggcacagatgtaaagcactcaggaattccttccagttataaaattaaagctcacctttcagtgggcaggctccttctgagacctggatcttctctggttcttctgaacagatacttagcaaaaatgacaaaggctgcaacaacccggcgtgtgactgatgccgcttactcctttacaagcccctttctctctctctctctctctctctctctctctctctctctctctctctctctctgtcttagtttgactgtcacagcttccacctgcctcctggcagtgccgttcccatctgtgtgtcccttccagcccagggtcactctcacccgctactggctctcagcctcatccctgtggattccaggactcagtttgtctccatacttaccctctcctcctacatcacttaagggttctcttagttattctttaatttatattattaaatataatataaattatattatatatagggtgggagggaaatggaggcagttccagtttaaggacctacagggtagacagaggctgccctgtgtgcatgtcagagcactggctggggcgactcctggcttggctccctgccttggcctccagcttcccacgccctgccctccccagtggaaagggcctgtttcgttccaaggaagattcttcttcaccctcctttcctgccttttctcatcaagacatccaggatgcctccagagcatgcagacccagtggtttgttggggtgagaggtggatgtggatgtgccttcatctcactcagctccacccctgcccgactgacctctttaccagcggtgttggatcatgattggccctcccctggcgctgtcttacagagcttccagaatcagacactgtcttctcccatcccgcaaaactacttccgagcatttttcatggccccatgaccatgcctttgaaatcctgcctcttgtgcttgtttatcagattggagtcggggtgcccctccctcccttatctctgtggcctttctcgggcccctgccctgccctccttggccacactgccgttacagggcctccattacctgcagaggggctactctgggttgggccctccaggcgtgtgtggtgggccaaagccctttgggttcactcagccaccgctaaatagttggggcccagcctcaggctcacagactagcataccccctcttttgcatcagagtgcaccctctaggtccccattgttgggcgcgggagctaggtgggggtattcccagaggccagccctcagagttgattcataggaagcaaagcccgaatgcccttgtgtggtccttggcagagagcactgataggcctctgtggctggtaggaaatgttaactgtggttagcaggtggtgtgatgtatgaggaacaacagaattcaaaaagggagtgtcccaaaaagaggagctatgtcacaggtgtttgttggctggatgaataaagcggaagctgtcctacactttagaaatggaataaatggagttttgctttgcagtagttaacctcaattccatgtcataaaattatcaatctatttctagcattctgcatttgtgtctcaaggcaaagcccacatataccttggccactctttcctcctcagctgccaagtctgactagaatatggcagctgcagcctgcaagtaacattcttggctctcaagacagtgcctatttcaaataatctgtcatttatcatttatttctcaaactgaaattgcacagcccctttgttctaagcactgtctcattatcaggtcatgtggcccttttctatttcatgaaatgtggacatctcatcctttcctagctcctcaaaagataatgactttgggggagccagtcacgtggccatacatctacccattatgagacctaggacacagatactgtatttaatacagtgcaactctaaggagagatatatgaacaaaaatatcatttgagaccggaagcagtggttcactgctggtaatcccagcactttgggaggctgagttgggcagattatttaagctcaggagttggagaccagcctgggcaacatggcaaaaacccatctctacaaaaaaagttcaaaaatttgccgggtatggtgacatgtctgtgatcccaggtactcaggaggctgaagtggaaggattatttgagcctggggtggttgaggctgcagtgagccatgatcccaccactgcactccagcatgggtgacagagtgagaccctgtgaaaaagaaagaaaaataaaagaaaaagagggaaggaaggaaaggaagggaggaaggaaggaaaggaagggaggaaggaaggaaggaaggaagaagaaaggagaggaaagaaaggagagaggagaggaaaggaattatttgaggcaataatgtaagaggtctcctcgacctgacatagccccctcaaaatccattgtccatggaccaagatagccagctggttctcacaccacccctatacctattgtaaagcagaatccctttagtgctgagtaaggtagatctttaaattactcccaagaccaggaaggtctaacagttttatgtgcatttattcccttttgtttggccaagaaccaggaaaatgggctactggctaacctgagaaatgggggaatgcatagttgctgctttttaactaaatagtctctcccagcaaagccaaatctaaatcactgagtgactcccagtgataacaacagtgattctcagactcagggagcactggtatcccctggagggctttttaaaacacacctcaccaggctccacccccagagtttattcctgattcaggaactctgagtgggtccccagttcttgcagctctaacagttttccaggtgatgtggatgttgctggtagcgcaccataccactacatacaggctccataggttctgtcccgtagatatgtccctagcttcatctgtgcttgtaccgtcccccacccctgtgatcaccatggatacctcaccccagagtcacttgagcctctctccattcctgggtgtcttctgtccttgcacctgggtgcagctgtgtatgccaattgctttggcgacagcattgtaccctccaaggcaatgtccagtcaccctttagctcaggtgaagtatgctcttctctggcaatccttctgaccacgatttgcccctccatagtactctgggcaaaccttcagcactgcaagtatcaggcagtattctgagcactgattcactcaaaggtgtccctggttgtgccatgccttgtgtagaacagatgcccagttaaggtttgttcaatgtgatgcacccattcactgagcaagcttatggaatggctactgtttatgttggaaagcaggtaaggggaggctgcagaaaacgcacaaagatgaaaaagactgtccacccaacttgtcacataagggaaatgaggatagattacattttaagtggatttggaggaatctataaagaaaatgttcaattcatttcccaactaaattattcagcatgcctgagaaaggcagcattcttcaaacgtgaaattctgcagtgaggctcttagcagactccagccaacaggtgaattctgcacatccagcagaggccatttcctttcaatgggaagggggcaggaggcatgagggaaacagaacatggctggtggtcttcagcacaagagatgcctgttctaatcattcacatccaggcaggtgcagtgagcatttgcacgtctactgttttactgtccctttaaaggatgatgcatctgccacaggcggcttgcagccgactgattgagaaggacatataaaataagtcacttgcacaccgtgcaaatacattgacatggtgcgactgttgtcatggagatcaaaagagaaggtttcttaaaggaagtggaggttgggagggatttggaagctggagaaagggcatctgggaggatgaaaggaggctgttgaggaggactacaggagaaaaaaacctgccaggctaggaagggggagagagcattccacagatggcagataaatgaaagaaatgagaagaaatcaggatcattactgaatccaaaggcaaatgaatgggggagtaaagttcaacatgggaaaaacaatctttgtgtgagaaacctaacaaggagcaggcatgaccttctcttagatttgcactgcgttcaaggggatttgagaagaggcaaacagaaagcactcacttaggaaagaagtcggttgtttgtaaatacgtcctcaaggatttctttaacttaaacacatttctaaatttcaacattttccctgtggaaagggccttgttttattgagttcttaaataggagtagaagggagcccttagttttttgttttttttgtgtttttttttttccatatgcttacgtttcaaaggactcctttaatttgtcttaagatgactggttaccaggtgagatttgctgtaaatctgcaggtccatcatcataaaaacatgtaacccaccggctggctgagtaagtgagcaaattctctttctggaatccttcttttaagaaggaaaaaaatgaatgacagtgtccaaataaattggctcatcagaagctattttcatccctggtggggcctgggcaatgaagctcaacccctccaaatcctgcctcaacctgtcatccttctgtgtaggccagcaggctaagtcccagtgcggaagccaactctcagcttgaatccacacttcccggctgtcacactagactgctgagttctccacttctgtagtggctaagccaggcctctcttcaacagctaaaccatgtgtctgcagtcaaggaatttcttctgacttcatacccttgctatcagtcctttacccagttagattataaacctgtacctgtgatcattcttacccacctcttttttttgcatctcatgtgtgttcaaaaccattctcttctccatctgcaagaatatcttctgagaacatccacagtgttgaagccccgatttagacagggggaaataacaagtgagatttcattctgtagggttctttgcattctagagcttgcaatgacattctttgaaaccacgtttcattgagaatggtggccactagaggaggtagaagtgatcagtgaatgccagtggagaccagggagggagaaggcttcttggtgggagtggtctagggaagagccctggtgagctggaagctgagctggcctgcagagaaggagtagtgggggtattctttgaaagaagaaggaagaacattttttgacaacagcttttataaggtgggaatatgtaagacagttgggatccccaccctttttcaggcagtcagagaggaacgcaggtgagcaagcaacacccaggaggcattagtcttgagagatgaggcagcgatcagatctcacaacaggtactactgagatcgggagacagagatcaaagaggcatggtcaaagtggtttcctaggaaatttgtcttctccaatattatgcaactcagattcaaaatatgtttccagatccctacctgatttcttgttttccttttcttcttaccccaccattaacctcattcactgagtttcatgaaagtgaaccattatttccacccatgtatcaattgttctacagtgctaattaacaaccttaatacagtgttctaaagatcatttccctataaggatatattctctataccccagaaaaccatctccctttgttcctagtagacacatgctccaagcaaagatgtctaaagcatcattcaaaacaattttccagttaaggatcttatgcactaatttgccttgggaatatgaagcccactgccagacaaatggattcacgtgtctccactaagcacaccttccactcctactgactcatccataactcagagtgagcctctagtgtcattttcgaaaacctgaaccacaggccataacatttcttacacttaatatacaaaatccctacatttatggatttttttcagaggttgttttaaaatacatccacaaggatttctttaatttaaatgcatttctaaatttcaatctgactagtctatctacaaattaataaagtaacttaaactttccctgataaagaatttttgcttgcttttatgcataaaaatatacaattttctcttcatgtgatctattaaattttcctctgattagaaatgccatgtatactattactttacaaaactaacaaactttgcaaaagggtgaaaagttctctgaggctctatgagcggttaataccaaatacaactttggagaattcctaccctgtacttgccttgagatagttgttttaacatatttgaccttttgtttcttcatgtgtaaagaagcatacttatactgtgtggggttttttagggaaagaaaatgaaataatatacataaagcaccaattacaatgggaaaaaacagtgttcaataagtggaagtggaggtggtagaggtagtagtagttgtggtcattgtggtggcattcatgttggtgtgggatagtaatggaatgatggatggttgtggtgatagtgatattggtgttgggatagtgatggaataatggatggttgtcgttatagtgatgttggcactgggattgtgatggagtgatggatgttgtggtgacagtggtgttggtgttgggattgtgatggagtgatggatggtggtggtgacagtggtgttggtgttgggatagtgatggagcgatggatgttgtgacagtggtgttggtgttgggatagtgaagaagtaatggatggtggtggtgatagtgatggtggtgttgggatagtgatggagcgatggatggtggtggtgatagtgacggtggtgttgggatagtgatggagcgatggatggtggtggtgacagtggtgttggtgttgggatagtgatggagtgatggatgttgtggtgacagtggtgttggtgttgggatagtgatggagtgatggatgttgtggtgacagtgctgttggtgttgggatagtgatggagtattggatgttgtggtgacagtggtattggtgttgggatagtgatggagtgatggatgttgtggtgacagtggtgttggtgttgggatagtgaagaagtaatggatggtggtggtgatagtgatggtggtattgggatagtgatgaagtgacggatggtggtggtgatagtgatattggtgttgggatagtgatggagtgatggatggttgtggtgatagtgatattggtgttgggatagtgatggaatgatggatggttgtggtgatggcaatgttggtgttggaatagtgatggagtgatggatatttgcggtggtagtgatgttaatattggaatagtaatggagtgatggatggttgtggtgatagttgtgttggtgttgggatagtgattgagtgatggatggtggtggtgatagtgttgttggttttgggatagtgataaagtgaagcatctttttagtgacagtgatggtggtaacatcaaggatgatgatggaagtagtggaggttaaagtgtggtttgttggtgaagtttgtgataaatatggtggtaaagttggaagaagtgatagaggtgcttctaccattaggttaattttatggcagtgatgttgatactggtggttgtaatgttggtgatgtcagtggtagagatgctattgctggtggtggtggtgttcacagtatttttgacagagatgaagctggtggtgatgatggtggtaaagatggtagtagtgatggtggtggcttggctgtgtgggggacctgagggagtggcattgatgttggcagtggtgacagtgacctgcagaggtggtaagcattgattggtggtggtggtcatcatggtggaggtgccagttagtgttgtaattgaaatagaaagataacctagagatgagttagcacactacctttgtaaaaaacagctttattgagatacagttagcatgccatagcattccctattttaagtgtatgattcagtggtatttcatatgtttacagagatgtgcagccgtagccataattgtaaacatttgcatcaccccacagagaaagcttgcaaccactggctgctgctcccatcctctcccactaccttttaagtctgtttttaaaccttatagtttggggacctgcaagctatgaaactgaaagtatatgttccctttataagaaacacatctcacttcttcctcaggtgcaacaatttattctgcatgaaaactatagatcatattagcaccctgaaaaaaaaagatgtaaaaacactactaccatcaaataacgcataactctactccatatatttcatttcaaaattggaatattaagaaaaatagaggagagctctcttgtttgttccttgtgatataatcccttaacttaccctatgatattgcacatctggaagaataataatcaaaaaagccctatctcattaacagccaattgaaacatggacttaaaaaataagatggtcatctacttctgggacttgagttcaataaataaacttagaaacagagaaactatattgtgaaggtgtctaacatagcatttgtggtagtaaataaacctggaaacaataatatccccaacaattaaaaaaaggttaaataaaataaaacatcaatatgatggaatatgatatttaaagactatgaagtaaagatgggaatataatcataatagcatattaaatgaagaagaaaaactcagacactaaattgtacaggctacaaacacagctatgtggggcaaaacactttactttagataaatagactgaaatgcatcaaaatgtgaatagaattgcattggatagaaatggtggttgtttacttttattataaaacaaaatgagataattattccacacaatattttgcagaagtatcaactaagaaaaaataagctttattttagaaccacaggactgaaatgtagttcttctaagaaaaatgtaaagaattttctttttctttttaacaaaatattgaaatggaacagaacaaaaacacctgcgttgtctattatagttaagctagttaggatgggttttcacccatggagaggaaacaagggaagatttctcctttctacctgtacaaacagatcacaggcaggattaatccccccaaactggaggaactacatgtcagcaagcaggtcccttcattcttgtggaggatttagctaaattggtggctctatgaaaacactttctcacaggcatttgactttactgtctactcttcttgacctgactccacagcccccatactgtgaatccaacttgctgtcttagggaggcttaaagcctcaccgggagccagttgaacaattagaatatttaatggatgtaaatctcatttaaaaaataatattattttatttgggtcactatatctaacattaaaacactaggtaaaataggggaaatctctttgttggtaaatttgacttataggtgacgtttacagggaaattcatttgattaattaattaggtcacataaatgtaattcagtggttgcagcaaaacaattttcacatagagtaattgaattttcaaaacatagaatcttgaaatctatttctaaacagtgagaaaagccatagctcatcaatgcaaaagccagcacatctgtggattcagaggagcatagacatttgtttataataaaaaaggtatgagctcttccaccagggtctaactccgagccaacagatacaaataaataaatggtttacgcgactgtttcactgacacctgctggcaccatgaatatactaaattagattggctgttgggaaaagcaagtggagtccaagaaaaccataaatggagaaacttgctgtgaaaaacaaaaatgattttactgctcttggataagtcagacttactactaatgacaggctgaggcatggaatcccctgggaagttattattaggcaatccataagtgtttgctgaatccatcaatgctgttcatcagctcgaaaccttcttctgacttctcattgtctgccctcccccggtcacatttggcaggttttcaaggtcttgctccactctgtccgttccctcctgacttaccgctgggcaggtgtgcaccctttgcaggctccactcaccccatcctccttctacttctctgagccgtgccccgccacctccccccctccgtcaagcccacctgggctctgagtcttcccaccacttcagaccacccatactcacactttctagatgcctgctggccttcactttcttaccatgcatttccacacttcatagttctctacaggttcttaagtgcttatttcctctctgcaggtcgattataaacactttcaggacggagaaagctttcagaggcttgagagatccagatccatagtttgtacttaaatgtatgtgtgtacgtgtatatgtatatacatacatatgtacatgtatacatacatacacatgtatgtgtgtatgtatacatacacgcatacacataaacacacatatctgttgactgcctgaaagtctacaaaacctttattccctagagcctcatcttggtggcattcgcatatctttttttactttttgagactgagtcttgttctgtcacccaggctggagtgcagtggggcaatctcagctcactgcaacctccgcctcccgggttcaagtgattctcccattttagcctcccaggtagctgggactacagacacccaccaccatgcctggctaatttttgtatttttagcagagacggggtttcaccatgttggccaggctgttcttgaactcctgacctcaagtgatccgcccacctcagcctcccaaagtggtgggattacaggtgtgagccaccgcgcccagccttataccatccttgaaaaggctctggtttctaaatgagtcctacgcatcagcctaaatcctactttgacctggtggaccatcttcacatcagcagggtggagttagcaccagcctctctcttgccccacatttaatcacccccaaatcattccagaatgattcggggcttcatgaaagagattaccttcctattgggtgtgcactcaccttcccatgccagttttcaacctggaaacactgtgattctgggatatttccttagaatgtaagctccatgaggacgggggtcttttcttttgtcttcttacatttccaaactcaattctattccctggtgcctggaacaaggcctggcacacagcagcgagcccgagagttcttgctgggtgcaggcctgagggtcagtctcacccggtcgtaagcgtacctggagacgccacaaacatgatctgtattttgacactttctcgccagttagacaagtcaaccagtacatcatgaaggacagaatgagagcgcaggctctggggcccaacacccatgttcagattccgctcctgccatgcatactcaggtgacctcctgtgtccattgacggtccagtggctcagaggggctgggagggccggatgcattcacaggtaaaggaagggtgcctggcacagaccaagttgcactgtacgtgggtttgcggctgctaccggaccaccgccccagcatcgtggcgatgactccactttatttctgctttcctacgtgggtgtgggcgttgatttcgctcttgtcctacctcaagacttctttagtgtgttcttttctctcctgtttaggctcccaagaaacatttgcaaaatgggattatccgtggctaccaaataggttaccgagagtacagcactgggggtaacttccaattcaacattatcagtgtcgacaccagcggggacagtgaggtttacaccctggacaacctgaataagttcactcagtacggcctggtggtgcaggcctgtaaccgggccggcacggggccttcttctcaggaaatcatcaccaccactctcgaggatggtaggttcggccggggcctggtcgtggcttttccctccgcaaaggttccctcgggtctgccccggggctcccccaacctcgcactcccccgccccacgactttgcagtgacctgcagggcctggggtctcgggtggaaaagccttccctcgtgacctcgcccaccccgctgatctgcccgccctggggcagggctggactgcaaagccagcaagtccctcccttttcagactcttcctcattcatttcaggtacaagaattgggcttttctggagtgaaaacaaggctctctctattactgcagaagtctcacgagaatgcagaaatgctatttgctaaaaaactttctcccaaatgttaagaaggttttttaaaatttattttatttttcattgtttcctattttcaagcattctgagtacagagaaaaggaattttcagattgcacagtgatcgatcgccccctagcggccgagataaattaattagcccttccaccatgtcactgagaataacccagaagctcaaatttccagtagtgcttgaaaatagagaaccctggtatccagaggcacagtgttttaggcaggaagttaagatatggggttatttgtagcaataagtggtagctttgaaggcaggaagctggcactacatttacctcttgtgcagttagtcatttgatcatagatttttttttgagacggagtccggctctctctcccaggctggagtgcagtggcgcgatcttggctcgctgcaagctccgcctcccgggttcacgccattctcctgcctcagcctcccgagtagctgggactgcaggcacccgccaccacgcctggctaattttttgtattattagtagagacgggttttcaccgtgttagccaggatggtctcgatctcctgacctcgtgatctgcccgcctcggcctccaaaagtgctgggattagaggcgtgagccaccgcgcccggcccttgatcacaggtttgcggaggcagataggacttgcacctgtaatatctgacaatttttgcgaggagaggagtcttcaatgacttgcagcctgaacactggaattgtctatcttcataattgcaatagtcgttaaatatgcctttgtttttgcttcaatgctcatttttcattaagatgcgtgtctcagccagtattttgcaccgccccagcgccaacatttaaggtttacaaaagctcagtactaaaaatattttcaatattcttctgacctgtctatggtctctcttccctctagagaaagggatgaggatgagacaggagaaatctatgattatgtttctactttttagcactttacaatggttcagcttccaatttatatgccagatattactaaatacagaggtaccgtactctataaagtaaatgcaacttaaagaagtaacttccaagagtaaggggaaaataaatcagacaaacaatgattttctactcaggcaataaaattaagaagggtacacgactcaagtcccaacaactgtcctaaaagtaaagaaactaagttggaaagagagactatggaatccattagaatatatgcattgactcatgatattttactgagcactgagttatcataagatttttccagggaagtgatctttgttattttttctttcattttggggttgagtgcaattttttgcttgcatattgaaatattaaaatacgttgctttttcggttattgctttgctcataaaccacccacagttattacagattctaattatttgatttcagtgcccagttacccccccgaaaatgtccaagccatagcaacatcaccagaaagcatatcaatatcctggtccacactttccaaggaagccttgaatggaattctccaggggttcagagtcatttactgggccaacctcatggacggaggtaagaggactaaactaggactttgggtttgcctccagagaatgcatgatggaatttgcagacccctcctagttcctaacaaggggctcaggatatggcgggcacctctttatcaatagacactttccccttttctgtcatccctcatctgacatttgaacaggtctctttgtttaaaacatcacacaccttcgaaacccaagttgaagcctaggcgggggcggcacttgggaaatttcaacatggatgtattttcctaattatgtctatgtcaaggctctgcaggcagcaccaaaacctccatctctatctagaacattctgtgtgatatgtattctaaaatgttggcctcttcctacttcccaaatagaactccgcggggaaacgttaaatttcctgtagttgtgctgtaagtgggtgtgggaagagtgcccaggcacatggaggggggcactcaggagggggccaggaagttcagggccctcccgttttgtctcctgtttctctttctcctcttccttccccttctcctcctctctcttttccttgttctttatcgtgtgtgtgtgtgtgtgtgtgtgtatttcaagtggtagggcaaaatgttcctgtttgtttagggcaaggctttgaataaacgactttctcaagtggacataagattggggccacaagtttcttgcagcaacacctcagtgtcttcgccctcaggctgcgagtggtgcccaccaggctgggccgggctgcgtgagtgtgctggggcagagcgaggctgcagcccccagcaggaaaggcctctggaagcctgctcactgtctctgtcccaagcctggggggcccacacctgcctcctcccctgccctccatttccagccccctcctgcaccccccgtcactggacagtaccttccctcttgtttggggtttcttttctttttttgagacagggtctccctctgtcacccaggctggagtgcagtggcacgatctcagctcactgcaactctccacctccccgggcccaagcaattctcctgcctcagcctcccaagtagctaggattgcaggcgtgcaccaccacacctggctaattttcagtatttttagtagagatggggtttcgccagcttggccaggctggtcttgaactcctggcctcaagtgatctgcccaccttggcctcccaaagtgctgggattacaggcgtgacccaccacgcccagcctggggcttctttcaacccctctgactgggtgtgatccctgatgagtgctcacctctaattttgggcaaatgcggtcaaggacctatcccttccctgctcaggaccacctggatctgttctaccaggcagacccctgtccccatgcaggtaaacatagggctccacaggtggcagcagcctccacggttggtgcaacagtaaaggcaagaagacacatgagcagcacaagcattactggctcagcgagcataggcctttgagccttagctctgcatgtccctaactgtgtccctaacatgtgtttctcaggactgagagcagacctcatgcctttgttgccacatgtagtacctggagcactaccagccatgggaggcaatctagaaggacccccccccgccctccttggtcctgcagtagacacatttgccaaacacccactcgacactgagctcatgggaaacaccaaggttgctgtgtctgtccctgtggaggttccagaccagtgaccgagggagatgctaatgaatacagaaccacagacccaagaagggacagccccacagaagggcagatttaagtagatgattctgtaacaccttcacccctcccacctaaacacaagttttaaaacaccccagagtaaagagcaatgaaaatttgcaaaagtcatctatttttatggacaaaataccataggatatcattacatatgtttcttctgatttctactccttatattgagtggatgaaattaaatacccttaatgttctttgaaaggcagtgttatgctaagatgtcttttctgttcttattggaaatatttcagaatccagtggtgacttcatccacatcacccatattttctaagctcactcacatttgctagcattgcctgctggtatcttcattctaaaatgaaagatgtggcttcatacctttaaagctttgaaaacttgaatattcaaaaacataattctttaaacaaagaaatgcttgggagtgtgcatgcagctttttaaagatactttcactcatgggattaaaatcaaagtgatgagataaatgtgcgatgtagaagtctgcacttcatttccgaaagataagcaagaaaccttcagaaacatgaacctgcctgcgaatggtcactcttcctgctacctgagagatttcgtttatgaggcaggtcagttcacggggctactggacacttttgcacaaactccccagactgcagcctccgggactggctggattcccacagacactgagcaggaagtgactgctgaccgacaccacatacacgtgcgcacacaccacacatacatgcaccccacatacaccacacaccacacataccacacacacacctcacaaacatcacataccacaccacacccacacatatcccacactcaccacacacaccacacctcacacaccccacatgcacacacaacacacatacacacaccccacatacaccacacataccacaccacgcataccacacacacacaccacacatacaccacatatcacaccacacacacatccctcatataccacacgccacatgacacacacccctcatacacatacacaaactgcatgtacatcacccaccacatgacacacactccatatacaccacataccacaccacacgtacacaaacaccacatacacctatgaaaggaaaatatctttttggcccccaaaatcactaaggaaaagtcaagctggaaactgctcagggccaacctgcctcccattctattcaaagtcacccctctgctcactgagatagatgcatatttgatggcctcctttggaaaggctgatcagaaactcagaagaacgcaacccttcccctctcacctacctgtgacctgtaagtcccctccccgcttcctgtcttcttgcctttgcttcaggttgtcctgccttccagaccgaaccaatatacttcttacctatattgattgatgtctcacgtctccctaaaatgtataaaaccaaactgtgccccgaccaccctgggcacgtgttgtcaggacctcctgaagctgtgttgtgggtacgtcctcaaccttcgcaaaataaactttctaaattaactgagacctgtctcaggttttcagggtccacataccacaccacacacaccccacatacaccatgtaccacaccacatgtacacaccacacatacacacaccacacaccacaccacacatcccacatactcatgcatacacacaccacacatacatacacacacacacaacacacactacacacacactacacacacaccacacatacaccacacaccataaccccaggcacatctcacatacaccacacaccacaccacacacaccccatatacaccatgtaccacaccacacatacacaccacacacaccacacttacacaccacacacaccccacatatacatgcacacacaccacacatacaccccacatacaccacacaccacaccacacgtacacacaccacacataccacacatacacataccccccatacactgcacactatgccacacatacagcccacatatactgcacaccacatacatacacaccacacacaccacacatacaccacacaccacaccacacatacaccacatatcacaccacacacaccccccacacacacgtaccccacatacaccacacactcaccacacacacctcacctacaccacataccacaccacacacaccccgtatatgtcacacaccacacatacacaaaccccacatacaccacacacactccgcatacatatgcacacacacacaccacacacacccccaatacaccacacactacaccacacatacacacacaccacaccacgcacaccccacacgcaccccccacatacaccactcaccacaccacacatcacacaacacatgtaacacaccccatgctactcacaacatatacctcatacacacagcacacacatacaccatacacacacaccacgcacacaggtacacacacaccatgcacatcgcataccacaaacaccacacacaccccccacacattcacacaggctgagaggggcaaatattgttactaccactgtaattagcaatagcccgaatactttccaaaatacgtctaagaaagaattctgttgttaatgtggtcagatgaaataaaactggttagtatatttgatagggaaggttaaataaacaatattttgatgaattttctgatttttttttcatggtcagaaagttaaatcatggttaaggcctgaaagaaacaatttatttgagattgctaggaaagttgtatcctttgaaaagttaccattttcctctgaatttttgctaacttccatctcatccatctttcttcatggaaaaaatggtacattctgaaaggaagcaacaattaggtgccaactggagtgtgtgggcagctgaggcttgcttcagaagctattcccgcacctattgttttctgccttaaaaccctctgaggatgaggcaagatataaatacacaaaactattttgtttaaaacaaaatttttaatagaaaaaatctgatttctaaatttattttatatatttttttaattttatttcactcatgacctcaactgaacaatacacttcagttaatgtgtgtgtgtgtgtgtgtgtgtgtgtgtgtgtgtgtgtgtgtgtgtgtgtattaaacagccctacagaggcatgaaagctagactgtagaaactcatgtttaaaaagaaaaagcgttaaaaagaatggcaaactaaacactcagttttgtatctggctttcttctttttcattctttgctttttatttcttccatatctgctagtcacctagtatctgtcatcaggaaaatagccttccttcacagcctatgaggcgttctagcagatagagccaactgtggctcaggtagttttagaaatcttaaaattgggattttgactgcctttgtcttcatggttcatgataaattagttaatcaaaataacttgaaccccccccccaatgttaattctaattagtatattaaccattagcatttttaatcattttgttttaagtgtttgcttttttttttttttttttttccttgagacagagtctcgctctgtcgcccaggctggagtgcagtggtgcgatctcgactcactgcaagctccacctcccaggttcacgccgttctcttgcctcagcctccccgagtacctgggactacaggtgcccaccaccacgccaggctaattttttgtatttttagtagagatggggtttcaccgtgttagccaggatggtctcgatgtcttgacctcgtgatccacccgccttggcctcccgaagtgctgggattacaggcatgagccactgcaccgggccaagtgtttgctttctttaagaagatcagagaggccaggttgtccttctccctccccaccaggctcctcttcctcattctgtctgattcaagagttgcattctgattcaagtatttgccggagggtcacagctttctcctatattgtgaaatgatcctactttttctgtgaggtggacaccctgcactcttgggaaaaaaagaccttcatcagagtctcataaccagctaccagcaccctgccctgatcagcccctcccctcagctgtatttttattgattgcgtgtgtatatatctgtagggaggtacgtgtgtgatctttgacagtgaagtttctaaatctgaaaagatcttaatgagttctatatttaaagtttgtccattagcatatgagtttttaattagtttgtttaaagacagggtctggctctatccttcaggctggagtgcagtggcacaatcacagctcactgcagcctccagttcctgggctccaccgatcctctcaccttgagctacttgggaggctgggaccacaggcatgagccatcatgtctggttacatttgggtttttatcctaatccaaaagacttatgttaaatatattcaggaaaaggaatataattgaatatggaaagacccgtccttcagagatgagaatttccaatccatctgggacaaccaagtattgatattttgactacctggtgaccacacatgctcacacagtctcctcattttcgtaagccctccgttgagatttccaaattgtgacctttaacagctggcaccctgctggcctccctagaagacaggagtccaaaggcctgtctttgggccatcctcgccctgctccctccccagcaaagccccagcctacagaactgtctgcttctggtgctcccaggcctttggctcccactggggcctggactgtgggagccacatggagcccctttacccctcttcttgcaactcctagaaggcacaggggctctctggcatgtgagggacaggcctcagccatcccatgcagtatttgccatgctcctttaatgctgtatccgttccacattgatctttttggtgacaaaaaaaagatgaacaaaagatgttccacagtcatcgtaatcacaaaatacatggctattcatttgtgaacctccatgcaatatcctggacacacaaaatacgtggctattcatttgtgaacttctgtgcaatatcctggacacacaagagaaaagaaaaacaatgagcaggaaggaaaaccaagacaggcaaaaagcaaaagcccgtttaatctggccgacacgacggctcgtgggtgcctccattttcagcccattttctgctttttcccagagcgactgaggagagcagctgagatccgcggcctgtgccctcagccactgtgctgggctccttgatcctctctgtccctcgacttccttgtctgtaaaatgaatgggttgcaaaagtaattgaataactctgctggttgtataagttactatctgtacttagaatagcatagcgctggcacctaggcaggcatgcatatcacatccactccctatatggaggccagggagagtgagagggattgacaagcagctggattgtcagttgacgagcaggtctgccaaatcagagctgttcaacaaggaactccccagacctgctggtctcttggggtaaccggcctgctctgggtaccaatgtgtcgctgacagccccttcccctaggggaacagttctcaggcccttctcatgctctgaaggcgactcatttcaaaacccatcagccaaacaccaaggaagtacttagcacaacattcgtaagttttctcaaattgccgtgtatcatatgctggagttgagagcgcatagtgttccatctgtgaatgttattagttgatcccactcctgaaagtgaagcatttttagctgacaccaagtttctgacacatgggcatgtcacttcaggattgaagctgagaggagttcactccaggtaaaaagaggggttggctgagccactcagtttagctcaggtgtatttttttcttatttaaatatgttatcttttcagctttattaaggtatagttgacaaataaaaattgcatatatttcagacatgcagcttgttttgatgtatgtatccaatgtgaaatgctcgccacaatcaagcaaattaacagcgggtccaccatctcacatagttgccattttcttcctccacccccaaatgatacaaagtttcagttatgcaagatgaataagttctggagatctaatgtacaaagtggtgactatagttaaagacactgtcttatagacttgaaacttgctgaagagggtagatcagatatttgggatgaagttaggtacttaaaaatacatgtatgttaaagtagagcttgtttaaaataacaataaaacccctcagcttgcagaagcttcctaatgaatagtcggcagtggggctgccaagtgtgcagcgtgtgtgtgtcgccctaagtgtgctgctaggggtgcaggggacattgctcattagcacctgctgaagggtgagtggcagccctggtgctggccttgggttgataacacttaacttggagcgaattacttcgttttccagaccaacgttctgccttgtgttctggagcagtttggtgtgaatgttcttttccaaagggccacgtgacaccatgagctcacaggatgactgtgcacagtccctttgagaattctcgtgtccagatgatggctggacgggtgatggcatggcacagggacagtcagtggggacagtgcggaaaaacgagcagaaatgggctcagaagtgggattttgttttcttgttcttgtcctccagagctgggtgagattaaaaacatcaccaccacacagccttcactggagctggacgggctggaaaagtacaccaactacagcatccaggtgctggccttcacccgcgcaggagacggggtcaggagtgagcagatcttcacccggaccaaagaggatggtgagagacgggtgggcggtgggtcccagcagttgctggaagggctgggtcacagagagctcacttgcctttaccctgcagttcatcaggctattctcagtgcaaacctttgctgccctcccaaaatatcccagtgcaattcagaccattaacttcctctcttgcctttgcttgatgtgtctaatccattgcttcttcttcctctatattttttcttctttcttttctttttttttgttttttgttttttttggccaagtattattgtaaatagaaactcattttatcctagagctgtaatacttgtcatacatgttttgtatcttgttagaataattttagtagctattcagctattagtgtaaactctgattaaatccatccttccacttcttgaaaattatgtacagactgaagttctattattctttgccagctgaatcactttagaataagtccttaatttgagaacttcatgttaattttttttaattcttgcaagaattcatggtgatttagtaaaaatttaaattgctgctcattttgttctacaacaataattcttgctgttccttacaatttggattgggttgtgactattacccaaacgtacaaaaaccatacaacaaaggttctgtattattttaagggaaactctgaggggccttggccaagcctgtttaaggaacagataagttctgataaatactaccgtggtagtgagaaaagtagcctccaccttaataaaggaaggagcaactgatgtcaaattgatgcccacatagaaccttcccaaaatattccagcacagaagtatacattgagatgagacattagcagatctaaatgctgtgctggattgtctctgcaacttttgtcttcttgccgggactctgttccccaagcagtacaggggcgggaaagctgttggccattgctggtcacctcctgtgtatgggcaggtttgatgtctatgctatctcccccactactagagtatcaaaaatgctgttattccatcccatatctgctctgatggaagcaaagaacacctgctcaggggccatgatacgctcttctcttcagcctttctgcccctgacaatgactccctgttattctgagcctgccatcttccacgtcactctctgctctcaccttggcaagccaggccttgctcctccgagcagccccaggcatccactctcacctggtgtttttgctgcctctgtagcccttctcacattgtaatgtctacacccaaactaatcctcatttgctttagtttttttctaaaatgcacaggtagtccttccagggaatgtgcaggtgtcagccagttctgctctaagaaattggattatttagggaatctaaggttcaaatgtaatgccattaggaagtcacacatcaatagagatatctagaaagctaagtcctgagtgaaggcagccataagttaattttttaaaaatgtaacagacaaacagctgtgcaaatgctggctctgtcacctgctgcccgtgggtctttgggcaccttacctaagtgtctctgaactggattgtcctcagggacaatctgctgtagccatcagactgcacagaaccagtgtatgagagctgaagtggtgtctgaaaacacctgcttgccacagagtgggatgcttcctgaccctcaatatttgattatttgctctccactccttcagagtaggggtgaaatactcctttttacattgctaggcaataatgcaaatgtcactggaattattatttaaagagcaaattgatcatccacaaaatgttttgcatctgcatttttggaagaatgtacagaaatccaataagaagggaaggctcttcacagatccttattaactcacaattttagatcaatttttaattaatattggagttttaagaatcatggagttctgtctcaaaacttgaccccaaggcccaaggtctaatttgtcaatcaattatgctttgcttttgtctccagtgctgatagtgtatggagctgggattgactatcgaaaaccctgccttgggtaccccagttaccccaaggaagatgccatgaatcccacttttgctggtggtatgggacaaggactatgcagaactgagtgtcaatatttctttaggataagtctgcattttcaaaaagaagtggagtggtggatcgcttgaggccaggagttcgagaccagcctggccaacatggtgaaaccctgtctctactaaaaatgcaaaattagccaggtgtggtggtgggcacctctaatcccagctactcgggaggctgaggcaggagaatcacttgaacccaggtggcagaggctgcagtgagctgagatcgtgcaactgcactccagcctgggtgacggatcgagactctgtctcaaaaagaaaaaagaggtggagtgaagattgggtggaagaagagaagaactagaataatatcacttcatctcccaggttcacatgaaaaattcaataatttagaaacggtgaagaattgtgtcaaccacttttgtagactcaatacctaatataattaggcatttcagcagtttacagaattaaatgctattttatttatctgattggaagaagggacaaaggacaattcagagaacaaatgcccagtcaaattgattacagatcgtatttatacttcaatgagaaagctttgtaattttgaagtttggattacacttacaatttcaattaaattgtgtaaaaatacagatagatttccagtaaaataataattaccaacatttgctcagttctttctcaataagatactattttaggctcaggttgaagtttcagcgtttatcaacgttcttgcaagcgaagaaagatagctacattaacagcgagcatccgattcagttgtctatgccagacacacgtcctgtaccagtcttcctaatctagggagcctggaggcttaaactgtgttattaggtcactggtcatactaaaaagagaaacttaaccctaataaaggcaaaattgtacttttgcaagggattatttgcaatagaaatatttgtttagaggacaagtctgtgcttgttctctacaggtagtttctctaccactatctaaagattcttgggctcatagtcatattcacagttccatggacacattctcatgtctgtggtcataatctcagggccatggacatagtctcttatccataactatagtctccggtgcatggacatattctcatgtctgtggtcggagcctcagggccatggatatcatctctcatccgtaaatagagtctcaggtacatggacatattctcatgcctgtagtcagagtctcagggccatggatatcatcttttatccataaatatagactcaggtgcatggacatattttttggggtctgtgactactgctcacagttcacgttctctttccaggactgctctatcagtgagaacttgtaccccattattgctgcagaaacacgaaggacgacttggtgatctggcttttctgtttttgagcacaacagcaactaaacctgacttctaaaaacagttgtgaaatcctgatgccattttatttgccaatactataatacgagtcaagccgtaaggaaagagaacacaaacaaaatgcaatctattaatcttccaattgctgttttcactctgaaggcaaaagctagtttcagccttgatccctttacacaagagtaaactttgcatatgtatcaatagagatagttaagttcaaatatttactgaacacatcactaatgcacctaactctgaaggtacatgtgagagggccagcagcaggtgtaatatgtgatctctactccctccccaccatcaattagcaatctcattgggaggagatctgaaagtagagctaagaggaagcaaaaaaataagctgacatctggatacctctgaatcttctgaccacccatactttgagccatacatacttgtgaaggtgtggatagtgtgtgcctgtgacgtgtgctggggtgactatgtgaccacacctcagtagacctgaaagggggtagattgcatgctatgtttgcatagccaccagtggtgctgcccctcagtagacactgggaagtactgccaatccacactgctcaagattccagtgctctatagcctatggtagtgtgccatgtgcagtggcaggtataccagcaacacgacagacaagatgtcctagaagagattctaccatgtggctttccacactccctccactgcagtggatcccaaactaggttcttacctcaaactaggtgggcctcagcagtgcccagtggtaagcaagaggcccagtgggagactccattctctccctgaccccagcttcaagagccaccccacttccacttgtgttatgtgctgggtttccacatgatgatttggttaaaggatcagtcaaacatttaaagaatgaacactcttgctctagtgagaggaaaggccaaaaatactagagtcttatggacatgggaagagaaaagggacatatgtgcatgcttggtgggatgacagctgtgaatgtgacatgtccctccaggatcgtagcatctgcacggcacggcatggctcaggaaaagccactgaaaagttgtgggttcagaaggatctggctaccatggtgtaccacatatgtacatgcatgtttgtgcatgcacaagtcacacacacacctgcctgtggctgtttactaagaccagaaaaatgatggtgaaaaaaaatgaagctgactgcggtgtctgtgtgggtgtttagtcagacttttgtccgatattcatacttcaaaacaaggcaatactgtttcagaaaaatgattgtggtatttttacattaaggtatgttacaggagggcttacccacttgtatttattttctatgctgtggaacagattgctacaaccttaacacgttaaaacaatacaaatgtcttatctcatcgtttctaagggtcaggcatccaggtctggttgagctgagtcccctgctgagggtccgacagatgaatcacggtgtgagctgggcctgtgccctcatctgaggtcaaggtctcccaggctcacaggatatgggatctttttttttttttttttttgtttggttatgaggctggagtcaccagcttccagaggctgcctgttactccctgtcacaccccctacagcatggtagcttccttcttcaggaccaataggaaagtctcacatggcttccaatccctctgacctcttttgtctctgacctccatctcctcttctaaggggcgcatctgattaaacccagcccacccaggaaactttccttttcattaactgaaagtcaagtgattagaacctcaatgatacctgaacaagcccttcacctttgccacatggcacaacctgcccatgggaggaatctgtccatcatagtaacagatgccacacccattcaaggggaaggaatcacccaggcacatacactagaaggtaaggatcttggggacccattgtagaatcctgcctaccacacagacacgaatgaaatcatttttccactcttggaaaatctgtattgaggatctagtatgttccagatactggcccaggaactaaagatgcagagaaacaggatgggcatggtggggtttgcaagctagtgggggagacagacgttgatagatcacccctgagtggactgtgtcaagtgcaatgatgaagaagagtctcaacagagacatgggagccctgacctgacctaagctggtgatcagggaagacttcctggaggaaatgacgtgtgctagaacctgagagatgagtaagagttgccaggaagaaggcagagggtgggaaaaactccagacagaggcatcccaaggccctggatcatggcatcccaagggcccggggtgggagaagcaaaccacgttcagggaactgaaacagagctcagtgttggggagcaccatcagatcagggggagagcccaactgctgacctgtcctgtccatgtggacctccaaagggcccatcaagtgacagcaggaagagaattccaggtcctggttcttgcaactgagaagatgatggggccatttcctgagatggggcaagagaagcacaggtttggatagaagatggtgagtgctgttgtgactatgtcggtctaaggtgcccgtgtgaaacatctcagccaattggacacatgagacacagaagcatctgcagctcagaagggatgtccaggtgcattggaggaatgtagaagagaggattctctgaaggccacattctttactgcaatcaattaaacttaaatgcagaactcctctctatgatgcccaggaattcatgaaaacttcccaagtttgttttgaccttcataagaaaaactcagattaccaaaatggaatgtggtcactaagaatgtttcaagaaaatatgtcccagacagacatataccgttttttactccatcctatgccatctctgtcttctgcaactctcagtgtctggtgtttgtcattcaccactgagtcacaaagtaaaggctagtatcatttagtgacatataatccaaggacataaggatggttattagagatgatagctagaacttatttggtgcttactgtacagagaacaataaataaatgatttacatgaattatctcttataattctaacagtaaaaacataagccagcacagttattattgtagatttataaatgagggaactaaagattattagagaagttaatcagcttgtccaggacgtggaactaagtgctagagccgcatgaaaccagcagtgaggctccagggcccacacctttaagctttatgatgttgtccaaaccagaactaaaatgttaagttctagctctgaaaagattagctcagtcatccagaaaaccttccaaaatgccgtgttcttcaacttatctatgttgttattttattgtacaaagttctagtaaccatacaaggaaagactgtgtaagatagatcataaatccatgcaggaggagccaactgcgagtttagatggtgcagtaaaagtcccttgatcggctgtgacacaggcatgctcacggaaatcatcacttaaaacaaggaatcaccaaactttgcagtggccaggaagtacctgaaatgttgcattttaacttaaaacatataaatatgtatttattccctaatcattctctaatcacatgacttaggatcacttcttgaagttttgggtgaaaagattggagctctgtgccatcttttactccatgaactgcatttaatgtgtagcatctgcatttttcaactggtgtctcaagtaagagcatgtgaccatttaccaacgatctgtttgcaaattgggacaaatccacatgtcccattcttctcagtggtcctgaccaaacatagatcggccttcttctttctttcctttcttctttccttcttttcttctttcttttcttttttatccttctttccttttgtcttcccttcttccttccctccttccttccttcctttcttttttcttccctctttcctttcttccttccttccctccttcattccttttgttcttccctccttcatttctttctctttttaatttcttttctaacttacctctaaggaaggctttccaaagtagtcccattaactgtcatagaaacagctttctcttgcacttgaatttcattggtttacgtaattaattaacttacagtactacccatgacacgtacaattgtcacaaacaggttggaaacaaatacaactgactcctcttcagcagccattcaactggttggtgctaaactacttggcctcctaaagagaagctgtccagcaagaatgttcactgtggtgaacaccaaccaggggctttatggaaaggactgagagtgttggctaagctggggtgtctactaggattaaaatccccaggaaacgttcactctgcccttgttgttcaggaggaaccctggcagctctgaactaggttgtggatgtcttagacattaccctcacctgatagaggtttgttctcaagggattttttaacccaggatctatcatttatgtgtgttaccttttctagaccttccactgttagcaagacttgccaaaaatggattaccaagattttatattttcaaatggtgactatgtccaacccaagttagttctcaccagagctcttggttttgttatgcagacttagaagagtcaaggtgacgattatgagaagcacattcaactccaaaacaatttactgagcagttgcattgccatcaaagcagtaaaagactcacagatttctccaggggcttgcaagggacttctattggtttgaatttcaatgtctccatcaatgtggttgccctccatatggacagtgaggttaatgagaaacaaagcaagagctctgatgccttcctcactggcacctttgacattttggcatcttcttgtcttggccatctcacccgccctcacctcttcaacctggaaaataaaagaacaagaggagtgggacatgccttcaatctcactcccaaatcatgcttagtattgctgccaccatgttctgccttcttagctggtttacagaggagagtttgtcttacatggatactgtgaatctttgacccaataatccctattcatcaacaatatttccatacctctcctgagcccaaagtggtgccattacaaaatgactagggtgagggagggtggggtctctgatggctgaggtagttcaccctcatgcttctcaaattcaggatccaaaaggttcatccccagtacattcaaagccaaaaactgcagcagaaatgagactgatccagaagttaattctccagttatccagaggcaggaagttgccaggggctgaaatgggttgggaagactccccaggacaagagggactagaactgactgtattaggtcctagagctacaaaggaccacagactccaacattaggaatttatttgctgtctctgagttctggaggccagaagtccaaaatcaaggtgtctgcagggctggttctctttaagagctttgagacaagcatctgtcctgggcttctctccttggcttatagatgccctcttctccctgtgtcttcacatcatcttccctctatacatgtctgtctctgtgtccaaactggccctttttataaggacaccagaagtactggattagggaccaccctaacaaactcattttaacttgattacctctgtaaagaccctacctccaattacagtgtcattctgtggtcctgggggttaggacttcaacatatgcatttggggggacacagcggaacccataacgctcatcctgaaagagctgaacagtaagtgcggagtggggtcatgttgggaagcgtgggtccgcaagcccaagttgaggccccaccttgtgactaaacacacggctcttccagttccaggtcctcccgcgggtgtgaaggcagcggcggcctcagcctccatggtctttgtgtcctggcttccccctctcaagctgaacggcatcatccgaaagtacactgtattctgctcccacccctatcccacagtaagttggtaaataaccaagtgcctttcaagcgtctgccagggacgagctgcaggtgctcgcactggacagtttcgttcctttgtttcccacctacctgggtctttccagtggttttgttttgcccctgctgtctccacatacaaaacaaagtcctcatttacacctcatttgaaaatacgctcctgaatcatgacaagggggacaattgtctggaattattgtttatttggtgagttcccactaaactgccagcagcctgatcaaaatcaaaacccagaggccttgattgtgccttaattgatagtcagtggacaacacctattgattttactgttggactcatcatgataagcacttcacgccttccctccctcccttctccctccctccctccttccctccctccttccttccctcccaccctatccctcccttctttccctcctccatctctcacagggaaaagaatagcaggcaaaaccctattgtgctagaaatgagggactttaatgaagatctattacccttacagttacagcagtcagcctggttcattgtgaaggaactaaaagttatttactatttcaaagtgtggtttttgttatcgttcatattattcctgctgaataatcattataaagttagactgcttctgagaccacaccaaaacatatcaaaaagggaaattttaaagaaaagaaaacattaaaatgacccaccaaaattgacgatgtcttcatggaaacattatgacattttctgcagcaggtgccatgtctcttccatctttgtatctccagctcccagcatagaacttgacacatgtagtcattcactaagcgtttgttgagtgaatatacacactggttttgtttcctttctggtaaaatacacataacgtaaaacttaccctcttgaccactttgattattgagttcatcagtattacataccttcacgttgttgtgaagccatcaccaccatccatctccagaactctacaaaaccgaaactctgtccccattaaacacgaattccctatcctccctcccaccagcccatggcacccaccattctactttctgtctctggatttgactcctctagggacctcatgcatgtggaatgatatagcatttgtcatttagtgaccagctcgtttcacttgacatgatatcctcaaggttcatccatgttgtagcatgcgatggaatctccttccttgttagggctgaaaaatattcccaaacaaatttatggattaatcttttaatcaaggtgatatgtttgcccaagctcagagtccacaggtgcccctgaggcctggtgtaccccaacagtgagtgtgtgagagtgtgtgggcttgcttggcccatgaagttccgtctgttgctgaaaaagcaaggtgtgttctctactgcttatgcattcatggcagtactctgcccttgaagtcaatatgtaaacgtaaatagtcagagttagactccacaacatttttctgggcttcttatgtggttttcaatatgctgttaatcctcacttactgaatcctactatcaaagcccagagatggagagcagcgtagacactgaaaaaaagctgagccattgtgccctcaatgcccagggtggcttctgcttttctgcttatcactgacatgtcccgtattcaccaaagagagacaaaaattattgctgaaataaagtatactcattttccactagaacttgaattgcatctgtattagtattcactcattcattcattgatctctttgctatgggattcacggttgctcttttgactctaacaggctagaaagcacctagcagggtatagaaagaccagcagcttcctctcgttttgtcttctcaatcatcttatctttatctctgcactaaaaatccctacctggcttacttgaaatgagtccttagtgactgatgcttactgagaaagcccctatttgtggatgatacaggctgtatttggctctgtcctcctggcctaagaattacatacaatagaaaaggaagaaaaaacatcctatcctgaaaacaaagtcacacaggtgttgttagatggggtagaaacgcatttccccaggatttctcctgtctcttcacccacagaacaatgggatttgacctgcccaggatcttaacaacacactctcaaaagggacagtaatgagggccagcaaggcacggtggctcacgcctgtaatcccagcactttgggaagccaaggcaggaggatcacttgaggccaggagtttgagaccagcctggccaacgtatgaaactccgcctctacaaaaaatacaaaaattagccaggtgtggtggtacatgcctgtaatctcaggtacttgggaggagctgaggcaggagaaactcttgaacctgggaggtggaggttgccgtgagccaaaatgtcaccactgcactccagcctgggcaacagagcaagactctgtctcaaaaaaaaaaaaaaaaaaaaaaaaaagacagtaatgagagcaaacccaccagaaaaaggtgggaaataacagctgagatttttatcagggtatctctgtgttgccttttgaccatattaaaaagactagagacatagaaatatgatgggcaggtgcctgtgttcttccaggagataatacctagaaagtgttacaaggaggtcccagaaccccagagcatcttaattgaagtgaagtgaactaaaaacagttccctctccatatccaccttcctgtctatctatctcaaccatcatttaagagcacgagacctattttttacatcaaatagtatcagtgagagtcaagctcagagacaattatttctcttcagaggtgaatacttgtaaatagtatccattattctgttttaaatatgaaatgatcaagaaactttaaagtacaggaaagagggtgtttttttgttttgttttgttttcatcagtttctgcaatttgactttcagtcggtaaactagatgctgtcaagttttccaaggcatttgcatttctggctatgtgtgcgaatgaccaccagaggacagtatgagctctagatattttccttgctcataaatctgaatttttttttctttgaaatgatttcatagttaaatgtagaacatagggggataaatcaggacacaatatgccttgtaatttggtcccttttataagagtccctcagctaacctcctcgctgatgtcattttctctcaagatcccaaattcatctccccttcttgggaaagaaccctgttaaaatagacaagcttttttctctaatatgtgacatataatgtctgctgataggcatttatttcatggtgctctctcagtttagcttagaaaaagacattagaatttgaaacttgcatgtggccagatgacaagttagggtaactgagaatgaatctacaaacaggttgtctaaagatgatgtggactgaacatgaactttccctcgggggtccaacagtgcaatgagatattaaactccccaatcagagattcaaactgcaaaatctcaaaagtcatttgattcagagcctcatccacataatttgtggattctggctattaattttaatatatagtggtttgaatgatcaaacaatctattataagcaatgaaaatccaaagacgtgagataacccttttaaggtcccaggaagaaaacagccaagcttcatttcctccccaacgctcccgtctacataaaagcagtctgaaaaactttcacaaacagactgcttttactatatacacattaaataagcattatgatatagacattgtctgtttcacaatgctaatctcatttgcggagcttagaaatgtaaaattaggaagcacagacttctcattaatgaaaactaaaaatcagaaggcataaaatatctctgagctgtgattcacattggttattccagcttcagatgataatgttattcagttcctgtacatagtaggtgctcaataaatgttgctgagttaatcagtgagaatacaccactactcttcttacccagaagacctgggcaattaagttctccacattgtagcccataacttagaattaaacaagtcttctgggaggcaaagtaactcaccaggtccagacagcttcccaccccaggcaacaggtgtgtgtttgcctcccaatcagccacagactgcatcaaataaagccatagtcaggctgagagcgaaaggggacttccgagaaccagaaatgtgcaggaatctcaaggagtggaaaagtggtataacgtggaatctggaaagcagcatctaacgtgctcatctgtatctacaatgatactcatcgctgtgttcattcttcctctctcacacggaacacggacctcctggctgtattaaaacgtcgttcctccctcccagtaccctccctatttcatgtcactgtagcatatagtgacgctactagatagcaatttgcttttaaaatcctccttctcttagcttccattatcatgttttttattctttgttgcttcttgtccctctgcttcccacccttaaatgtaggcatttcccaatattcttcctttatctcttaatattcttcactatctctgtggatcattgaatctgttcttataatgtaactatcatctgaaattaaagagttcgcattttttatctctatcctgacaatcttagagaaccgtcagtcctatatttccagcttaccaccatctgcgtactcaggaagacctctccagtacttcgcattcaatgtgcccacaaacacatttatacttgtgtctccctcttttcctgtgttctgatttagcttacgatctaacaaaatctgctgccttctgaccagaagccttcaagctacctatagttcctctcctaatcatttattcatttttaccacaaataaacatagagcactactcttacaccaagctctgagccaggttctgaatcacatcaatcaagagatgctgagttagggggcatcacaaacaggcctgaaacctcagtgatttacaacaaccatacaacaaccaatggttttatttttctttcacgatcatgctcattgtgagtatgtggtagtacatgccatgctatcttcactccaggaaggacccaggcaggtttcatgacaaagagaaagaaatctctgaggcgctgacataggcaggtaaacgctccaagcacaaatcacgagccagaatctgtcataagattctggtccatgtcttaaccacaaagggaccatgacgtacgctccaaacccatacccagaagttccagggaaggcaggaaacactagacaatgtcacccttctgtgtgatgtgacagaggacacagcaatgatgtgcacagcacagtgcaggagcgcggactgggtgtcactcaaacatacggccagagatggttgcttggaacacatagctagccctggcttgcaggaagagaagaattttacctgatgaatcagaggcaggaaagggtaatatgatcagaggaaataaatgagcaaagtgacatcatgtcacaagagctctctgcaatgtcttttttgttgtttgtttgttttgagacggagtttcactctgtcgccaggctatagtgcagtggcgcaatctcggctcactgcaacctccacctcccaggttcaaacgattctcctgcctcagcctcctgagtagctgggattacaggcacccgccaccccaccaggctaatttctgtggttttagtggagatggggttttcaccatgttggccaggctgctctcaaacttctgacctcaagtgatcggcctgcctcggcctcccaatgcaatgtcttcttaatctccttcctttcacacccaatgccattgccttgcttcaggtcctcccctggagaatcaaaaccaagtcagaagccttcccactgccaggctcaactcccagtctgttgtccacatccctgtcacaattcctttttccaattctgaatctgagcatgttatttcctagtgcaaatttattggatgacttcgcagtttttacctaaagacattcaaaattctcaatatgacctagatagatttccacaatccagctgcatctcctgtctagtttcatattctaaaaaccttcttccatccaatatctaagtaataccatgtctcatatgtgtctgcatttgtgcacgtgtgtgtatgtgtgtgtgtgtgtgtgtgtgtacacgtattgggtttttcttaccttttccattccatcctctttggtaaaaatgtttattgtttaaagctcaacttaaatgctgtatttttatttcaccactttttatcactggctacacattaggcaccgagtgccaaaagctttatacctatggtttttgaacttgccctatggtgacccacgatagaaaatataagttataatcacgccacgaaagtactcgcacaccacaaacttacatttactacacgtgatgccctccgatattttctgttccatttgactttttttctattctatttcattttgtttttaaagtgattgtcatgttccattaaattcctcctatgactcacatttttaaaaatactgttttgcatcagttaattctggtgactaccttacgcaggaggtgttatgattgttatcttcactcagtgatactgaaatgaagactctgcaatctggccagggtcacgcaggttagcaaaggaagatgggatctgcaacccacagcgggctgagctctttgtcctcatgcttacctgccttccctgggatcccagttccatcctgccccagtactcccagcactgactttcaacctcactttgacataaccacaatctcttgcgttattgttagacatgggcatagactggcaaacctggtattgtgctgaaatagtggatgttcctcaaatgtgtgttgaattaaattttatagatgatgactgtgagtcatctaaaagaggttaaattgtgtaatgaagctgtagcttaataaggcaagaaattgtgttatgtactttgggatgctttgtatcccagaaggatttggatcaagtgcctgtgcttttaaatcacttacatagaaatcattcttccatcattttatttaaatgacttaaggatgaatctttttttttttttttttttttttttttgagacagagtctcactctgtcacccaggctggagtgcaatggtgcgatctcggctcactgcaaactctgcctcccgggttcatgctattctcctgcctcggcctcccaagtagctgggactacaggcgcccgccaccatgcctggctaatgttttgtatttttagtagagatgaggtttcactgtgttagccaggatggtctcgatctcctgacctcatgatccgcccgcctcggcctcccaaagtgctgggattacaggcgtgagccaccgcgcccggtcgaatctctctctttttttttttttaataatggaaaatctgaaaattatggagataccacaagttggcctaaaaatagacaattgtattccatttacgcacatgtaatgaatcatatacatgagacctttgtgcagtgcttctacatggcaggcagatgctaggctctctatgttcttggatcaaccaaggattactgtagccccagcatcctgtcatggaatcatacggctggaaaaaacctcgaagggtttctttgaggcaaggctacatctaaatatcccagacatgtgaaaatcaattctggttttataaaatttcttgggaagtctattcctgaagctttcttggaaatatctttttatttcacggctagttctaatggaatgcagttcgttattttttcacttttaagttcaggggtaacgtgcagatttcttatataggtaaacttgtgtcacaaaagtttgttttacagattatttcatcacccaagtattaatcctaatacccattagtagtttttcctgatcctccccctcctctcaccctccaccctctgaaaggtgtgtgttgttgttgtgttgtgtgttgttcccctctatgtgtgtgtatgttctcataatttagctaccacatacaagtgagaacatgtggtatttgtttttctatttccatgttagtttgctaagaataatggcatccagctccatccatctctgcaaaggacatgatcttgttctttttcatggctgcatagtattctatggtgtatatttatcacattttctttatctagtctatcattgatgggcatttagattgatttcacatctttgctattgtgaatagagctgcaatgaatatatgtgtgcatgtgtctttataacataatgatttctattcctttgggtatatacccagtaatgggattgccaggtcaaatggtatttctgtcattaggtctttgaggagttgccacactgtcttccacaatgcctgaactaatttatactcccatcaacagtgtatgagcatccctttttctccacaacctcaccagcatctgttattttttggctttctaataatagtcattctgcctggtgtgagatgatatctcatcgtggttttgatttgcatttctttttttttattattatactgtaagttttagggtacatgtgcacaacgtgcaggtttgttacatatgtatacatgtgccatgttggtgtgctgcacccattaactagtcatttaacattaggtatatctcctaatgctattcctcccccgtccccgcaccccacaacaggctccagtgtgtgatgttccccttcctgtgtccatgtgttctcattgttcaattcccacctatgagtgagaacttgcggcgtttggttttttctccttgcgatagtttgctcagaatgatggtttccagcttcttccatgtccctacaaaggacatgaactcatccttttttatggctgcatagtgttccgtggtgtatatgtgccacattttcttaatccagtctatcattgctggacatttaggttggttccaagtctttgctattgtgaatagtgccacagtaaacatacgtgtgcatgtgtctttatagcagcatgttttataatcctttgggtatatacccagtaataggatggctgggtcaaatggtatttctagttctagatccccaaggaatcgccacactgacttccacaatggttgaactagtttacagtcccaccaacagtgtaaaagtgttcctatttctccacatcctctccaacacctgttgtttcctgactttttaatgatagccattctaactggtgtgagatggtatctcattgtggttttgatttgcatttctctaacagccagtgatgatgagcattttgtcatgtgtcttttggctgcataaatgtcttcttttgagaagtgtctgttcgtatccttcacccactttttgatggggttgtttgtttttttcttgtaaatttgtttgagttcattgtagattctggatattagccctttgtcagatgagtagattgcaaaaattttctcccattctgtaggttgcctgttcacgctgatggtagtctcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctaacatttaagtctttaatccatcttgaattaatttttgtataaggtgtaaggaagggatccagtttcagctttctacatatggctagccagttttcccagcaccatatattaaatagggaatcctttccccattgcttgtttttctcaggtttgtcaaagatcagatagttgtagatatggagcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctatgaagaaagtcattggtagcttgatggggatggcattgaatctataaattaccttgggcagtatggccattttcacaatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcagttgtaaatgggagttcagtcatgatttggctctctgtttgtctgttattggtatataagaatgcttgtgatttttgcacattgattttgtatcctgagactttgctgaaattgcttatcagcttaaggagattttgggctgagacgatggggttttctagatatacaatcatgtcatctgcaaacagggacaatttgacttcctcttttcctacttgaataccctttatttccttctcctgcctgaatgccctggccagaacttccaacactatgttgaataggagtggtgagagagggcatccctgtcttgtgccagttttcaagggaatgcttccagtttttgcccattcagtatgatattggctgtgggtttgtcatagatagttcttattattttgagatacgtcccatcaatacctaatttattgagagtttttagcatgaagggttgttgaattttgtcaaaggccttttctgcatctattgagataatcatgtggtttttgtctttggttctgtttatatgctggattacgtttattgatttgcgtatgctgaaccagccttgcatcccagggatgaagcccacttgatcatggtggataagctttttgaagtgcttattcggtttgccagtattttactgaggatttttgcatcgatgttcatcagggatataggtctaaaattccctttttttgttgtgtctctgccaggctttggtatcaggatgatgctggcctcataaaatgagttagggaggatttcctctttttctattgattggaatagtttcagaaggaatggtaccagctcctccttgtacctctggtagaatttggctgtgaatccatctggtcctggactttttttggttggtaagctattaattattacctcaatttcagagcctcttattggtctattcagagattcaacttctttctggtttagtcttgggagggtgtatttgtcaaggaattttaccatttcttctagattttctagtttatttgcatagaggtgtgtatagtattctctgatggtagtttgtatttctgtgggattggtggtgatatcccctttatcatttgtattgggtgtatttgattcttctctcttttcttctttattagtcttgctagcggtctatcaattttgttgatcttttcaaaaaaccacctcctggattcattgattttttcaagggttttttgtttctctatttcattcagttctgctctgatcttagctatttcttgccttctgctagcttttgaatgtgtttgctcttgcttctctagttcttttaattgtgatgttagggtgtcaattttagatctttcctgctttctcttgtgggcatttagtgctataaatttccttctacatactgtcttaaatgtgtcccagagattctggtatgttgtgtctttgttctcattggtttcaaggaacatctttatttctgccttcatttcgttatgtacccagtagtcattcaggagcaggttgttcagtttccatgtagttaagcgattttgagtgagattcttaatcctgagttctagtttgattgacctgtggtctgagagacagtttgttataatttctgttcttttacatttgctgaggagagctttacttccaagtatgtggtcaattttggaatacgtgtggtgtggtgctgaaaaaaatgtgtattctgttgatttggggtggagagttctgtagatgtctattaggtccgcttggtgcagagctgagttcacttcctggatatccttgttaactttctgtctcgttgatctgtctaatgttgacagtagggtgttaaagtctcccattattattgtgtgggagtctaagtctctttgtaggtctctaaggacttgctttatgaatctgagtgctcctgtattgggtgcatatatatttaggatagttagctcttcttgttgaattgatccctttaccattatgtaatggccttctttgtctcttttgatctttgttggtttcaagtctgttttatcagagactgggattgcaacccctgcctttttttgttttctatttgcttggtagatcttcctccaaccctttattttgagcctatatgtgtctctgcatgtgagatgggtttcctgaatacagcacactgatgggtcttgactctttatccaatttgccagtcagtgtcttttaattggagcatttagtccatttacatgtaaagttaatattgttatgtgtgaatttgatcctgtcatcatgatgttagctggttattttgctcgttagttgatgcagtttcttcctagcctcgacagtctttacaatttggcatgtttttgcagtgactggtactggttgttcctttccatgtttagtgcttcctttaggagctcttttagggccggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgctgagagatcagctcttagtctgataggctttcctttgtgggtaacccaacctttctctctggctgcccttaacattttttccttcatttcaactttggtgaatctgacaattatgtgtcttggagttgctcttctcaaggagtatctttatggtgttctctgtatttcctgaatttgaatgttggcctgccttgctagattggggaaattctcctggataatatcctgcagagtgttttccaacttggttccattctctctgtcactttcaggcacaccaatcagatgtagatttggtcttttcacatagtcccatatttcttggaggctttgttcatttctttttattcttttttctctaaacttctcttctcacttcatttcattcatttgatcttccatcactgataccctttcttccagttgattgaatcagctactgaggcttgtgcattcgtcacgtagttctcatgctgtggttttcagctccatcaggtcctttaaggacttctctgcattggttattctagttagccattcgtctaatttttttcaaggtttttaacttctttgccatgggttcaaacttcctcctttagctctgagtcgtttgatcatctgaagccttcttctctcaactcatcaaaatcatcttccatccagctttgttctgttgctggtgaggagctacgttcctttggaggaggagaggcattctgatttttagagtttccagttcttctgctctgttttttccccatctttgtggttttatctacctttggtctttgatgatggtgacgtacagatggggttttggtgtggatgtcctttctgtttgttagttttccttctgacagtcaggaccctcaggtgaaggtctgttggagtttgctggaggtcctctccagaccctgtttgcctgggtatcagcagcggaggctgcagaacagtggatattggtgaacagcaaatgttgctgcctgatctttcctgtggaaattttgtctcagaggagtacctggccgtgtgaggtgtcagtctgccccactggtgggtgcctcccagttaggctactcgggggtcagggacccacttgaggaggcagtctgtctgttctcagatctccagctgcatgctaggggaaccactactctcttcaaagctgtcagacagtgacatttaagtgttcagaggtttctgctgccttttgtttggctatgccctgcccccagaggtggagtctacagaggcaggcaggcctccttgagctgcggtgggctccacccagtttgagcttcccggccactttgtttacctactcaagcctccgcaatggtgggcgcccctcccccagcttcactgccaccttgcagtttgatctcagactgctgtgctagcaatgagtgaggctctgtgggcataggaccctccaagcaaggcacaggatataatctcctggtgtgccgtttgctaagaccatcggaaaagtgcagtattagggtgggagtgacccgattttccaggtgccgtctgtcacccctttctttaactaggaaagggaatcccctgaacccttgtgcttcctgggtgaggcgatgcctcgccctgctttgcctcatgctcggtgcgctgcacccgctgtcctgcgtccactgtccgacactccccagtgagatgaacccggtacctcagttggaaatgcagaaatcacccatcttctgcgtcgctcacactgggagctgtagactggagctgttcctattccgccatcttggctccacaccactgatttgcatttctctaatgatcagtgatgttgagcttttcctatgcttgttggctgcatgtaggttctcttttgaaaagtgtctattcatgtcctctgcccacgttttatcggattgtttatttttttcttgtaaatttgtttacgtttcttataaaggctgaatattagacctttgtcagatgcatagtttgcaaaaattttctcccattctgtcagctgtttactctgttgataatttcttttgctgcacagaagctctttcatttacttgatcccatttgtccatttttgttgttgttgcgaattgcttttggtgtcttcatcatgaaatctttgcccatgcctatgtcctgaatagtattgcctaggctgtcttccagagtgtttttagctttaggttttacatttacattttttaatccatcttgagttgatttttgtatatcgtgtaaggaagggagccagcttcaatcttctgcatatggctagctagttatcccagcaccatttattgaatagggagtcctttccccattgcttgtttttgtcaggtttgttgaagattagatagttgtagatgtgcagtcttatttctgggttctttattctgttccattggtctatgtgtctgttcttgtaccagaaccatgctgttttggttactgtagccctgtagtatagtttgaagtccagtagcatgatgcttctagctttgttctttttgcttaggattgccttggctgtttgggctctttttggttccaactgaatttttaaaatagttttttctagttctgtgaagaatcttaatggtagtttaatgagaatagcatgaatctataagttgcgtgggtagtatagccattttcagatattgattcttcctattcatgagcatgaaatgtttttccatttgtttgtgtcatctctgatttctttgagcagtagtttgtagttctccttgtagggatctctcaccatcctagttagcttcattccaaggtactttattctttttgtggcagttgtgaatgggagtttattcctgatttggctctcagcttgactgttgttagaggataggaatgctagtgattttcgcactatcctgagactttactgaagttgtttatcagcttaagaagcttttgggctgagatgatggcattttctagatatggaatcatgccatctacaaatagggatagtttgacttcctctcttcctgtttgaatgccttttatttctttctcttgcctgattgccctggccagaacttccaatactgtgttgagtaggagtggtgagagagggcatccttgtcttgtgccagttttcaaggggaatacttccagcttttgcccattcagtatgatgttggctgtgggtttgtcatatatgggtcataatactttgaggtgtgttccttcaataactagtttattgagagtttttaacatgaatggatgttggattttaccaaaagccttttctgcatctatttgagataatcacattggctcaaaataaagggatggaggaaaatccagtaagcaaatcaaaaacagaaaaaagcaggggttgcaatcctagtttctgacaaaacagactttaaaccaacaaagaacaaaaaagacaaagatctaactgtcctaagtttacatcatcctatattttacataatggtaaagggttcaattcaagaagatctaactatcctaaatatatatacatccaacacgggagcacccaggttcataaagcaagttcttagagaccatcaaagagacttagactcccacccaataacagtgggagactttaacaccccactgacaatattagacagatcattgagacaaaaaattaacaaagatattcaggacctgagctcaggtcctgaattagatggatttgataaatatctacagaactcaaatggatctgaaagatatttacagaactctccacccccaaacaacagaatatacattcttctcattgctacatgacacttactgtaaaattgatcatattaatcagaagtaaaacactcctcagcaaatgcaaaagaactgaagtcgtaacagtctctcagaccacagcacaatcatattcaaaatcaatactaagaaattcacttaaaactatacaaattacatggaaattgaatgacctgctcctgaatgactttgggggtaaataatgaaattaagacagaaatcaagaagttctttgaaactaataagaacaaagatacaatgtaccagaatctctgagacactgctaaggcagtgttaagagagaaatttatagtactaaatgcccacgtcaaaaagttagaaaggtctcaagttaacaacctaacatcacagctagaagaactagagaatcaagaacaaacaaatcccaaagctagcaaaagacaagaaataatcaaaatcagagctgaacagaaggagatagagacatgaaaaaccattcaatggatcaacaaatccaggagctagttttttgaaaaaaaaaataaaatagatagaccactagctaggataataaagaaaaaaagtgacaagattcaaacaagtacaatcagaataaataagtgggatgttaccactggccccacagaaatacaaacaaccatcagagaatattatgaacacctctatgcacataaactagaaaacctagaagaaatggataaattcctgaacacatacactctcccaagactgaaataggaagaaattgaatccccgaacataccaataatgagttctgaagttgaggcaggaataagtagcctaccaaatgaaaaaagcccaagattagatggattcatggctgaattctacaagatatacaaagaagagctggtaccattcctattgaaactattccaaaaaatctaggaggggggactccttcctaactcgttctatgaggccagcatcatcctgatacccaaatctggcagagatatgacaaaaaagaaaacttcaggagaatatccttgatgaacatcaatgcagaaatctcaacaaaatactgaaaaactgaatccagcaatacatcaaaaagcttattgatatagtttggctgtgtctccactcaaatctcttcttgaattgtacctcacattttctccatgtgtcatgggaaagacccggtggaaggtaattgaatcatgggggcggattttcctgtgctgttctcatgatagtgaataagtctcatgagttctgatggttttataaagagcagttcccctgcacaccctctcttgtctgccaccatgtaaaacatgcctttgctcctccttcgccttctgccatgattttaaagcctccccagccatgtggaactgtgagtccattaaacttctttttctttataaattacacagtctctggtatttcttcatagcagtataaaaatgggctaatacacttatccaccatgatcaagtaggctttattcccaggatgcaaggttggttcaacatactcaatcaataaatgtgattcatcacataaacagaagtaaagacaaaaactacatgattatctcaatagatatggaatgtggttctaaatcttctcagttttttgtgtgcaatttttgcctatttatttgacttctattctttaagaaagtggaagggaagtcgatgttgttttttataagtttatcatttaatagtggtcttttttccctgttatcctattcacagtgtctgttctcacactgctaataaagacatactcaagattgagtgacttacaaaggaaagaggtttaattgacttacagttcagcatggctggggaggccttaggaaacttacaatcatggtggaaggggacacaaacatgtccttcttcacgtggcagcagcaagaggaagtgcagaaccaaggcgggaaatgccccttataaagccaggtctcatgagaactcactcactgtcacaagaacagcatgagggtaaccacacccatgattcagttacctcccacggggtccctcccacggcacatggggattgtgggaactacaattcaagatgagatttgggtggggacacagccaacccatatcacacagtgaacaagccaataactactcaatctttctgttgaagctatatttcagttttcttctcatattgttctcagtggttgtttgtccactaggcattatgtgaaatcattcaattgctataactggtaaaatgcagatggcctatactcaaggtagaaatcttggcctttaaaattctgagcccaatcatgtaatttatagagcaaagaaaacttaagcatatactcccctaaaattttcatacagaaagaggccctggaaatctcttttgaagctcagtctcataagactgcctgcctgatttgtcagataacctgtcactaagcattctagctttgaggtagcattcattcagactaggtagcttagtgtatgccaccctgaatgtacttccccattgctgcgtagagctttctgattatccacaggctaaaatgcctttaaaaaacttgactttattttttaagcagttttaggttcacagaaaaattgagaagaaggtacagagattttccaaatgcccctgcccctactgcacagcctcccccactatcgacatcccccaataaagtggtgcatttgtaacaatggtggaacctacattgacacatcattattagccagtgttcatagtttatgtaagacttactcttggggttgtacattttataggtttggacaaatgtttgatgacatggatccaccattatagcatcatgcagaagtttcactgccctgaaaaccctctgtgctcctcctattcatcccaccctcttaacctctgatctttttactgtctccaaagttttgctaaaatgccctttttatcaattagcttttggagcttttggaagattgcagctttgaaaacatcttatctttttgacttggcctgacacagacatattgtactatttaaggaaataaattggctttaaatcatttttcaattaacactagtggaaagagctatttttttcaattttgtaaattctgcatatattatttttattactaagaattgtgtttctcattaatttcttgtatgtgagaaactatatgataacaaattagtttttttgtacagaatttgttgaataggtgacagcaatcaagttaaattaataatgtaactttgacagatagataattttcatggcaggtggtatgacaatgaaaaggggatgaggaaaaattgtagcaaagggagattatatcggttggaaagagcctgttaacataagtatctgtaatgccacctgggctaattggatggtgcttctaattctaaacaattacatcaagaaactagtttttctcatgccttctctggatatcaactttaatatagttgcaaaacattatagcaataacttttatatttggaaggccaaaaataaaatattttatatttgaaaggctttttaaaagtagccaatagtctatgtatataattatatatatagtctacatatagtcatatatatagacatatatataatggtatctatagtcatatatatatatatggtcatatataaaatattttatatttgaaaggctttttaaaagtagccaatagtctatgtatatagttatatacatagtctatatatagtcatatatatagtcatatatgtaatggtatctacagtaatctcagtgaaaggcagaggaaactaccagaattgcctggctgttatcccatttctaccaatgttggcctctcaacctatgcctttaggaagatctttctgccatgacatcttcttttatagatgggaactgtgaaataaaatggaaattagatcaaaatatattatacataagaattttaaaaatcttaaattaatgcagtgaactgctaattcttaatggaatccaggccatttctttgccactaaacaagaagatgttaagcattctaaaagttcccttaccctataattaaaagagctatcaattttgtttattgcttgggggagtttttttttcactgctgtggacattctatctatgaaatcacagccttcaagtttttttaattgcatgttaacaattagctatcagagctttttaaaacatcacatttccttatagaattagtttttcattaaaaagttaattgaaatttttaaaagtagaattccttttatatcagacaggctgaatagtttgacatgaacagcctatggctttgtagtcattttatcctcattatttcctatcgtactcaaatcatttctaggtcattactaaactcacctagtacaacaagaatttcttcagtgtattccagttactggtcattgagtcccagctctaagcaatgctctgaaccaggttccctgcagagtgagtagagggatgggtgagtaaaaggagtagagggatgggtcggggagcctgacccctggggagatgcagtaagcacatgcaagaccataacccacagtggaataaaggcaaaggctatgaaagacaaagggcagacttagcccctgattgagaggactagagaaggctctgcaaggtcttacaagtgcagctacaagctaagtaatgtgaggggttcggaaatgaatttggcaattattgggtaaacgtctagttttatagacatgaccaaagagtgtttaaagtgcctcactgtggctaattatatcttatttactggtcaaaagcatcttacacatgaaaagaaaaatattatatcaacaccacaaggcaacaataattgtggaatgaaggcaggtctagaagacgctgttcccaggctttccatgagttgaccctgaagcactaggagaaaactaacttcctcacaacccttacactcttttgactggaagagtaaactgtgcacatttagttccttaggaacccacgactctacccagcagacctaaagcagtaacatacaaagacaaaacgcttgaaatgtgaacgctctggcttgggtgtcacaagatttatcccatttactgtattttccactctggatacggctttggggaggcaaacatgtcagaagtcttgtaaaaccttgctataaatattttttaaaacaaatatatgaagtttccatttattttttaggcatcttataaatattcatccatgtcttcaactatgacagggttggttttagagaaaggttcaaacgagtttatatctaaattttagtaggaattggtcagacttctatggtgcctcattttaaattaatctgtttgccaagctgtggtcacttcttgctccccgggggcaggaacttgccttataatctacacactgcaactgaactcagtaaatgaccattaattgaaactcagtaattatttacaagcccttcctattacgaggcatgaagctaagaacttttgcctagattttcttcccacagcccaaaggagagaacgatagtccaacaagcttctatgtctggctcatggggtcctataactctcgccaacatcccttatccacagacctccatactttgaaggcagcagtgtctgcctggacccccccccaccacctcccacagtaaaaaccatgaccagcccactgtaagaatagtatttgagatggttcattacataagcaacatgcatattttacattttatgtgtgtgtcctcagaccaaatacccaaatcttcccctaagaacactgtggattgcccctgttacatgacatcggtagagcaggattccccaacccccgggctacggactaatactagggacctatactgcatgcttcttatgggaatccaactaatgcctgatgatctgaggtgaaacagtttcatcccaagaccatcccatcctaccacgtccatccatctgtgaaaaaaaaaactgtcttccacgaaatctgtccctgatgccaaaaaggctggggaccgctgagccagagagagccctgttcttctcatgccaccatgttatctggtggaccaagaaatcagtaacttggcagccacttagagcctttcaattgagaagtgattaattaataataaatgttggcttgcttctcaacttggatagagcctacatgtttaaacacattttagatgagaaataacaggctttttcctcagctagccaagaggaatatatgacagatgcaaaataattggcaaccccagtccacaaatgtcccatccacttcctcaagctgggcatagacagagcaggattaaaaataagccatggaagggaatccctggcattctggttcagggacatgggggatgggatccctcaagtccatgcctggcggcaacttcgtaatgttggctgtttctgtatttccacaggtcacaaaggaactcttatgtcttctcttcaaacaaatggttagcacaattactgtagtccactcaaaattaattcacactttaggcataacaaaatctaggatgactgacacgtctgtcttaactctaaagaagatgagactggagagttcaaagtctacctgaagaaaatgaaatatttaaatattaagaaaagtgtctctgttgcttccccacagatttctccttttgccacatttggttcattaatccctaagaaactccattgtgagtttgcccttctttataccgcagtgtttatctgttgtccttgatagcgaagctttgctttgtttctttaaaaaaaaaaaaaaaaaagattcagagtctctgaaatagcaacccagctgatatatcaggcgaaatctggaaatcaaagtgatcccttctcattgaacattctctatatttggaagagagtgctacgtaataaaatatgcatgtagaaattagcaagtcagtttacacactattggattgttgtgttggaaaatctggtatccaataaaaagaaaattaatgaaatataaatatagtccatgctatcctaacttaataaaatatggagggaaatatttcaaaaggagatgatatttatcatcccttcttttcagaacaagcatttttggctgagcattaaaaaggatttaatcaactagattggctccactacactgagagaacttctggttattttcttcccattttgctctttttttcttttttctcctacctactgttaaaatggttaataatgattgagttatgcaccatccatagctaatgattctgtttacaataaatactatataatttacactgcatccctctgttggaggcatttcatgcctatggttctctctctcaagacatccaggcttgctctgtcctctagggtcaaccagtaggcatccttaccctgcttcactctaggaggcgtggccagtccagcccagcctcctctcctgttgtgagcagggctaacctctgccactgtggttcgccattagccttctcaggtgtggctcacttaccaagctctgtgtccttcagactccaagttctccgagagattccctagagctcaaagccctcttccacccataagagggaatactcacagacctctctcaacagaaaatccttattcctgccccagcctcttttggagcctggaaatggatgactggcaaaacatgagaaccagcaagtcctgcccaggtggcctcacagctcttgttaggaaagaaggcactggcatctttaggagcattctcacgctttaagatcatcgctaaaacttccagagaacaggaagagtcaactttaatatccagttacatatattccaaagaaaataaatcaactctgatggtttaaattgttcagttatcaactttctgcttgcccttctactaagaccaggaaaattgtgcctaattatggcagtcctcagaggaatacacagtggcatcaaagggtggtgacatcagtgtaactaacttacccaaataaccaataggagccactaacagcttgacgttattatttttcatcctaacctacggagaaattaaggaagtttctatgaatataccttttttacttcaattcttgattagtcttctatataaatgatgaaacaaatcttgttgcataaaaagtcatattttattgttgattttagccatgcattatgttacaggcaaaaattaaagtgtgtgttttggaggtaatcaagaacgaattttaccttgtcaacaggataagtatggagttttaactaaaagctatgttgtctacacagaaaaagatctttattttataaatatatcttaatgctttcctgatgcttaatgttcagtaagagtaattgttagaatttgcacatcattaagctttgtaaaattaatttggcaatgacatagccttggagaatcacacaatgcaagtacatacagtctcaggattgtctctttggtttatcaggaaacaggccaaattccctctgaacttctagagggactaattttcccataatactctaagacgtgactggagtgttgtagtgggaggggggtggaggtgaggtgtaaatgagtgcatacacatgcacgtgcatgctagattatagtgatgtatctagggaatccatgcaagagtctctccaaatcatctgacactgtgtacccacaaattaaagttttgacaataagtaattatctgacattatgttttgttgaggaagcatgaggttgtatgacaattaagagatatagtgaagatttaaatcccctgtttaattgcatgactggtattgtaacttatgcagcctgctgaggcatgtaaggtttattgaaaagctaacaagagtaaaagtaagtccttcttgttttggtcacttctaattgacagcataaagtgtgaggaaatagcaccagacttgggaccagaggccctgagctggagccattgttctgcagttgtctggtcttgtgacatcagtgaatcacttactttctctgaacctcagtttcctgatctataaaatggatccagctccacctacttcacatggctttttaaggaacaattctgacctatctaggtctatgtctccttgaagttccattagttttgtttcatgtaataataaatcctaaacgtttattcacctaataaccaagcttcatatctttgaataataggtgaatattaggtgaataaatgtttagaattgttatgttctcttgatgaactgaccccattatcgttatgaaatttctgtctttattactggtaatatcctttgcttttaaatctattttgtctgatattactatagccattccatatttttttgattagtgttatcataggatatcacttaagttcctttatttttaacctatttgtgtttttatatttcaagtacatttctttctttctttctttctttctttctttctttctttctttctttctttctttctttctttttttttttttttttgagacagagtctcactctgtcacccaggctggagtgcagtggcacaatcttggctcactgcaagctccgcctcctgggttcatgccattctcctgcctcagcctccagagtagctgggactacagggacccaccactacgcccggctaattttttgtgtttttagtagagacagggtttcaccacgttggctaggatggtcttaatctcctgacctcgtgatccacctgcctcggcctcccacagtgctgggattacaggcgtgagccaccgcacctggcctatttcaagtacatttcttgtaagcagcatatagtcggatattgcttttatatcaggtctgacaatctttgcctttaatatatttagatcatttatacttaaaattattattactatgtttatgtttaactctgtgtagtgctatttgctatttgagttctgctgctgttgtgctacttgttgcccttgtcagtctttctctgacttctttggggttttttttgtaattccattttatttatcttattagttcattagctttattttatgctatattttgtaatttcagcagtttccttacaattcacagcatatacttttaacatcttagtgtactttcaagcggtattacacactttgcatatagtataagaaacttacaatcatatacttccattttttcctcccaacatttgtgctattgttaaacattttacttttatttatattatatacccacattacattggtattgtttttaactatcaaccatattttaataatatttaaataagaaataccatatatatgtatctgtataattacctcctttttctacttatttgtgtacatttatgtctctgtctatctggtattattttccttctgctggaaggactttctttaacatttcttgtaatgtgggtctactggtgattaattctttcagcttcttatgtatctgaaaaaagtctttattcactttcattttgaattatatttgttgaatatagaattctaggttgatttttttctttcagtacttgaaagaaatcattccactgtcttcttaccttgattgtttttcaaatgaaattggctgccatgcttatctttgttcccctttacacaacatttactttctctggctacttttaagattttctctctagcactgaaactaaaactcttgagtagtttgattatgatgctccttggtacagtttttttttttaatattcttgtggctagaattcactgagtatcttggctctgcgggctacagttttcatcaaatttggaaatttttcaaccactatttttacaacctttttttggtcctgtctctctcccctcctttaggaactccactatgtgcatgttaggcagcctgatatttttccatagctcactaatgccctgttaacttttttattctcttttctatgtatcatttattaatatgtgttgtgaacctcaaatatctgagacaggtctcagtcaatttaggcagtttattttgccaaagtgaggatgcgtgcccatgacacagccttaggaggtcctgacagtatgtgctcaaggtggtccgagcacagcttggttttatgcattttagcgagacatgagacatcaaccaattttttaacattggttccatctgaaaaggcaggacaacttgaagcaaaggcgggacaactcaaagtggggagggggctcgtgaggagggggcttctaggtcctaggtagataagagacaaatggttacattcttttgagtttctgattagccttctaaaggaggccatcagatatgcatctatctcagtgagcagagggataactttgaatagaatgggaggcaggtttgccctaagcagttcccagcttgacttttccctttagcttagtgatttgggggccccaatatttattttccttccacacctttaagttcactaatcagtttttctgcaatatctacgctgctgctaatcaagttcaatgtattttttatttcatgcattatagtttcattttgagtttaatttaggtctttttgtatcatatctacttaaatttttgaacatatacagttataataccgctataatacaattataactactttattgcccttgtttgcataaatctaatgtctgtgccaattatgggtgaattttgattgattgatttcttcttatgaattatgttttcctggaaatttttatgacagctttattgagatgtcattcacttttaacttcaacaattcagtggctcttagtatattcacagagttatgcaacccttaccactatctaattttagaacattttcatcaccctgaaaagaaactgcacgcccattagcagtcattcccaattttccccttcccctaccctgcccctgacaaccactaatctatgttgccatcgatctgcctattctgaacattttaaatgaagagaatcacaaatgtgtggtttcttataattggctcctttcacttagcataatgttttcaagatttatccaagttatagcatttatcagtacttcattcctttctattatctcataacactctgatatggcttggctccatgtccccagccaaatctcatctttaattatatagctcccataattcccatgtgttgtgggagagacctggtgggagataattgaatcatgagggcagtttcctctgtactgttctcctcgtagtgaataagtctcctgagatataatggttttacaagggggaaccccttttgcttggcctcattctttcttgcctgccaccatgtaagacatgcctttcaccttctgccgtgatcgtgaggcctccccagccatgtggaactgtgaatccattaaacctctttttatttataaattacctagtctcgggtatgtctttatcagcagcatgaaaatggactaatacagactccatggtatcgctgtgacatattatgtttatccagtcatcaggtgacacatatttgggctatttgtttgtggaaatattttagtaggtgttaaactttgtgaacttcaccttttggagtactacatgcttcaatttctataaattctataaatattcttgacctttattcttggatgtagttaagttatttaggaataatttgttctctctaagtcttgcctttaagaataattaggaaagactggagtggtattcagcctggggctaattatttcccctttgtggtaagacccttatgcactatacccaatgctcgaggaatcttgatgttttccaacccaactggtgagaacagccactactcccatccctgtgtgagcattaggcaccgtgacctccaattctttcaggtgtctttccctggccttgggtagtttcctcacatgcatccatggatctgctcagctgaatacccaagtaggaccctcttcaatctccagagcttgtcctttgtgtgtagctctctttccagtgctcttccttgtgaactctagcttccttcaggctctcagctctgcctccttagcttggaaaggctgccaacctcccgagttgaggaggtggagctctctattttatcagaaataaaatttacactgccctacaaattgcaaaatctctgcgattgtggggttttcttcattcgtttcccatctttcagagatcactgtcatttattacctgatgtgcaatgcttttagaaccattgttttatggatggtgtgtgttcctcagttgtttcaggtgggagggtaaatctggttcttgttactccatctcagccaaatacagaagtgctgtggcctgtaatgtaaaggggtaaattatttattggtggccatcaaagctgctgcagagaaaaatgtagatggtgggtcacttaaacttaccagttacattttatattgcaaagccagccttttagaggagagtgagttgagtttttttgttatgatatttaatatgttcatgaccattccttcgggaaatccatttttgccacatgcttctttgaatgtgggaacacttatgtctctttttacaggtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaaggtaggcagtggctataaggacctcatttcctgttgtaacttgactgtttttaagtctctattttacctgaaataaaacttacactttcctaaaaatcaaataaaccagaatatcacattttagctcaagaaacagggttgtggctaacaagctctgagcttctgtcccatggaaaagtaattccctggaggtaaacacaaagctgagaatgagtggccttacaatggaagtgtctatgaaaattaggaaaggagccctcattcattccttggagtagctgaaaatcattacacggcattttcccaaggatgttctactttcagcaaaatcaggtatcacacttcttaatgagaaatgtctattttatagtctatggaatttgcaagcttaaaaatatttgaaaatcattcactatctgttgacagaatgctataagcaaagactttaagtaacagcaggaagtaggagtcaccaaagaataaaaagttccttaaagtgaatataatatcttcacatttgtacgttaaactggtccttaaaaagcacacgcaggcacggggtattcttgctcttctggtaatcacggccatccagtgtttccaggaaccccctaaattagcattcataataagtcaatttccttacgacacaattccaggccagcaggagttgcccctaattttgagttatagaacagtggcaacttattactaatatgttctctgatagcctgaaagacaagaatgaacattccaagattccaattttacctccaagaattctctgaaaaatgtgctttttaatgagatagttaagaaataggcagaataaagcagtgaggggaaaaaagaggggtgtcacattttgagctcaaatacagatagaaaataagtaagttggtaagggaaataaactgggggacttactttatgtattacactctttggtcatgatatccagccactccctgagaatgagaaaatgatgattaccaaggaaaatgttggacataaggactgagctgtgggatttaccaaaaaaacaacaaaaacaaacaaacaaaaaaacactgcaacaaaacacataggattagcaataatgtttcttcctttcctttgtgctttcaaagttctatctctagacacagccagaaaggcctggctagtgcagtggggtatgacttactcagtgggggaacaattgaaaactctcacagaagcaggtcttgcctggggaaattcaatgtcctccagtcatttaataagtcattttgagtgcctgttgtatgtcagggtctatgctggggacacagaggatttggtcaagggaggctgactgctgaaataaatgttccctaaatctcagtggcttcacataataatatagtccaacagaggtatttttggtcagggctctcttgggtggcctgttccacatggtgattcaggcatccaggccccttccaccttatgatttacaaccctggatttctcctcatttacagctaaatagatgggggaagaagggagtatggagggtttgatgagaggttttcatgagccagatacggaagtgtatacattatttttactaatatcctattgtctagaataaaggcatggacccaccagggaaaagaaaacagggtttggagagcccagaggagtcttttgagatggtttaagagatgtgttcactccctgaccccctgaagcttacagtttggtggggagccagtcagtgatatggtttgtctgtgtccccacccaagtctcatcttggattgtagctcccataatttccaagtgtcatgggacggacccagtgggaggtaattgagtcatgggagcaggtctttcctgtgctgttctcatgacagtgagtaagtctcacgagatctgatggttttgtaaaggggagttccaccacacatgctctcttgcctgccgccatgtaatacatgccctatgctcctcattcaccttctgccataattgtgaggcctccccagccatgtggcactgtgagtccattaaacccctttcctttataaattacccagtctcaggcatgcctttattagcagcatgagaacagactaatacagtcagtaaacaaagcatcacaaaagtatatgcatagagacaaactgtagtaagtgctataaagaaatagtgtgagaggacctcacctggagtgtcagatggaggacacacttggtccctgagcacaagcaaaggcggttatgtgaagagagaagaagtgagcagtcagaagctcctgcagagaaagatttagcaggtgggaggtccaggacactggaccctgctggggccggggaaggaacagtggtcccagagacgctgggaaggaagacagggacctgatcatgctgggttttcaacactgtgttagggatttcagattttgccgcaagagaaataaggagatggtgtagggttttaagcaagggaggcacatgatctctctttctctctgtgtgcatgtgtgtgtgtgtgataaaccttattttttagaacagttttagatttacagaaaaattgtgatgatagtacagagagttgccatttacctcacacctagtttccctttttatagacatcctaattaaatgcctttcttacaactaatggcgggtgtgctttttaagaccacctggtctctctgtcctgaatggactgcagagaggcagaaatggaggagggtggagaaggagatagcaagaatgaacacccaaattctcacatgagttagcataagtggaggcacgatttcttgatgaagaagaccatggaagaagtggattttgaagccagtgagaggaggtacagacatttggaggggttcaatccaaggtgacgaagagccattcactcagaggcatctgtgcactgaggcatgtcctggctctcaagagacatctggcaggaggcagaaattcaggcgggtcagcgtctggatatcgcttacacctgggatgggaatgagattggctgagagatggaggagagatgaaggtgcaggacggactctcaaagggagtgggagcaggcaaaggaaaaggggaaaagccagagaggcagcagagccaggagggtgttaggctgtggattcaaaacagatgcttgcaaaaggagggagtggtcaggtgaggctgctgctgctggaaagtcaggcaaaaccaggcgaaaatgcccctcagtggccacacggaagatcgtggtgaccttcctgtgagcagcatcagtgggtgtggaggggcatgcagaaatgagcctgagtcaggtgagaaagtgggtaggaggtgaggggcaggctgactgggcagaacattccttcaacacacatcacctggaagaagtgacaaccaagagaagaagctgggagggggagggaggctctcattcgaggaaaggctctgggttcattatttttcatgaggcctgccatcagagcatgtttatgtggtaacgggaagatcccagtagagagggagaaacgagaaatcaacaatacataagaaagagcccacgaccacagcactgaggtttagaggaggaaatgccagtaggttcacagatttggtggctggaaatgcagggttcctggatggtgtctctgaagcattaggcaatttggggatagtggagggaagcccagaagtgtgagaagaggagggacagcaggaagccatcgttgcagggaatggggaggacatttactaaagaaacagtaagaccagcagggagtgctgacagttcaattgaggttgatgatcctaaatggtggtcaatctccaaatgctctattgcgtggattttttttccagaaatgttcaacttttcatgcttaagggaggttgactcagggttaggattgctgtaggtaggttttctggaaaggggataagctagggagtgcctcaggatggagcagacagtcagttgggcagcccccacccagaagcccagacactggcaaaccatgaaggctgaaaggcccatcctagagggatggggatgtccacagcagaggagattgagacaggttattctgtagttgttgggaagtcaaggcagaccagcagcagtctagcgacaggtagcagggtccaaaattcagatacagttgaagaagaggaggaccactgcttttatggagggagtggcagaatggggccatggcactggtcctgggggaagcccctcctaggaaggggtccaggacacgaaggcacagagagcctggccccatggctgagaacaaacgggacccgaatcagaggggacaccaggttgcagaggggttcagtttctcatcagaatcacctgggatgcttgtcaaaaggcagatgccccaagtacaggaaagagctgctgaatccacaaggctgtggtgggaacctgcattttaaacaaagattctaggggattctcttggctgccccaggtctagtgtgttgagttgcccagtcatacatttctggctagagaccctttaaatttcagccgtctaaaatgggcaaaatgggcattgagcgatagcatgggggttgttgggcttgaagatgaagtagctctagcttgtattttttaaattgctaatggaaaagcattcataagtcctggagttaatttgaggggttatgcccagaatgttaaagaacaacaatggaatagagtggaacagagtcaaatcaactagactagactaaactagggtttaaaaaagacagaaaatatcagaatgcatcacatacagtgaagtctttattcatgcaactttgtttgcacatacacaacatcccaatgcatgtgtagcttctggagtttgatgtaaaacatatttcttaaagtgggtgactgttataaagctggaaagcccctaactctagctgaatttctctagccacccgccttttactgctgaggacattctctactctctaaagaactgtctgaagtgtgtgaaaaagaaaatgccaaaagctaccaatgcaggaaatctgatgctgcctaatcaggacctttttgttatcatgatgcaaaatcagaaatgtcaatgactgatgaaatgggccctgccttagaatacttcatctcagtccagggaaattgcttgaaacatgggttttgctgcaacaaaaaacaaggtccagcttctaagccctctggcattttctttttctctctactcttgcccacagtgcccagaggcaaaaatgtatgatttggtctggtagatcctagtgactaatgtgggtattctatactaggatggctgcataatgacttggctctgggtactctgcccttccagggattctagagcttccctgggggagccttctcctcatcttcctttgccaatgcaaaccctcaacccagaaatggtgcaggggtctcacatttgtcccatttttatgggctctgaatcagttcaaggctgccttccacctatggtttccggtctgtgcatccatcgagggtgagctcctgtaggggcacctgtttcctctatgtccccagctccatgacagtgtctgaagcatactggctaaaacaaaggacaggagaagccccgggctcctgtttacaccccagaaagtaatgtcccaatgtatggcaaagactgagcagattgttttcctctggaagacttgtgtgtggtgtccctgtcagcttttgtgactcactgatggaggtagcactagaacctctcattgctggccacactggacttcaaggcaagttcaccctgggctttttctgactgtcttctgggacttctgctaccttggggctgcaccagtaccagatgcccctggcagatgctcctgtttgggcatctgaatcactgttccaagcaaatggttgttcttcaagagaggccactctgaaaatgttcattctccttaatgtgtgtcctaaagatcaacttgctataatacagtcgggaaattgttaagtagaacttgttccagttttactccttcccgtctttggggcctttgtgttttgtattgtctactttctctgatattaaagtatattttaatgagcagtttttgtgttgaggtaaattgcttcctaaagtgctttgagaaataattgggctcatagaaaacacagcttggagctgcttggcttatgaagccctagatatttaatttggactcctcatgtttagtcaatagaagaaaagaatgctacaatgggaattttctgctagttgtgtgttcttacaatgacaattcctcataacccgggtaccagagagtagtgttgacagttgtaatgtgaattggcttcacatccatttttaggtattgcccttattgagtaggtcatgttggcctctgtgtagacacgtctgtggagtaatcaggattccactttgtttggttcctcagctcctgcacgaatcctgaccttcagtgggacagtgactactccatggatgaaagacattgtcttgccttgtaaggctgttggggacccttctcctgcagtcaaatggatgaaagacaggtaaccagtaacccaatgtatgccttcagtgagactctaagagattacatctgacatactcaggttgtgtctagtggtctcctaattttgtgtttatttatattagtgaaaactcaaggaaacctaccaattcttctgagatgagggcagagaaggaatctcagctttagcactgaaagggtctgatttattgtatcaaccctctgttaattcagagccttctagttcatgagagaatgcttgcaaggaaagtagttgaaccaactcaattattgtggaagtttgctgcaccctctcaggtaaattgtccatgtaactgagatgaatgcagccaaggctattgtgagatttaacacctatctcttcttctttaaagatagtgaactaaccataactcaaataccctgagaaagaactttaagaaatggagtacattaggactttgctaatttaaaatctggttctccatactccatagtaattatttaaataataggagccaagatagagggagagagtgagtgagatatggtctgtccatataactttttaaagtgctatatctctattcaggagaagaaattaggatataagttaagggtcgaaaattcatttatgagcatagaaatgtgatctaatggattcagaagaatgcctattttcaagcaaaagcacttagaaggcataaactgtagaaataatggcttggtgtagtgaccaaactgtagaaataatggtttggtttagtgaccacttttctcatacatttaaagttggttcatccaaatgaaatatgtagctcccaaggtcaagttggcattctgcctgttgtgggaatgaccccaaaggactggacaatctgccaccggagcagtggttatgatggccacgcagttctttttatactagggtaaactcatcaccctcttgagatatcacatgtcatttttcatgtcaaaatcatgaataattgtgactttaagtgaatctaaaaatgatcccaaggtttagtttcccctgtatgatttgttcaaactggcacttctgcctacagaagaaattcccagaattgccaaaatgaggatatctccagtgcccacagagtggagtaaagagggacccatcagtctctggcacagatgaggagtccactgacttgagccagaatctgggcccttgacacagatctcatcttcaacgtaacattttttacaaaggaaaacttcagctacacagctattgattgttttcattatgtaatcatatttagttctttcataatgcaagaaatatgaagcttccaaatgtgtggtttgcttcacagagtctttctgtttttccccaacctcagctaatttggattgtaatttctttaatctgtgcatttttcttcctgtgaggcagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaaggtacaacatttgaggactctttttaatgatatcttttacatgtatgctttctatgcaaaaagtagcactgaacaaattttaaaatcagcccttataaagagctaacttctgtttccatattacagaaaaagaaaacacatgttcattttgcaaaatataattaaacaaatcaaagaaaatacaaagcattcacaacctcagaaatactgagatacaaaacatctttgcatacagaaagcctagtctcttttttctttatgtgtacatgtctaaaaaagtccttcttaataatttccattaattgcactgtttactctacatatatgtaagtgtatcccagaaaacacaaacaaaaaacaagtctgaattgtggtcttttttgtatgctaattaactcaatttttatatgcaatgtattttaaaaaatgaaagtaactggagctctaagtagatcgctgtagtatttagctatgtatttaatactaagtatttttcttgatatcatacacaaaatgtgcacaacttcaaaagattgtcatgttaaaattttgtgtaaatcccaatcaataagtgattgagttcagatttgtatgcacagcaatattttattagtagaaaaatcaaagtgtgtgcttctttggatttaggtgttgtcacattaatagattacagcaagtaaaaataaaatcaatactgttctcggtgggatggaaggaaaggaaaagaactatatttctaaaaatgctgcaaaattgatcttgaatttcaaattaattgaagtcaggagaattccagggaattttggaagacaggcactatattatgactctgaagagataggtcaatatattaggcttctctcagaggaaaagagaagggaattttatatgaagctttctatatgatttggataacctgattctgaatttctttagtgtttctgccctcagaacccatccagacttacttaccagtatgtattctacaagccttgtaagagagaccagttcatattctgcagttcaaaggcctgcttttgattttctgtgtgtgtgtgtgtgtgtgtgtgtgtgtgtgtgtgtgtgtgtgtgtgtgtgtgttgcatcttggagcaatagcttagaaagtgaagatttttgcaattctttttcccactagctatttttcctccttccccttttccatcctgagaagaacggaactgctaagtggatgccatttatctttttcacttaaatttcatggctgaaattcatagtaaaatgaggcatgtatccttagtaagtttaaagaagatttcaattagtgataaataactcagacagtcaaggaactggtgaggaaatgagttagatatgaatccaagtagaaatgtggctgaatttttttttaaataatagattcactccgttctatctctttagcccaggatatcaactaaatagacattttgacagaagtgaattgtatattttggcaaactgaaacacttatttaataaatggctgttaaaaatgagttggtaaatgactgttcaggaaagttaaagatgtgaaaaactaattcttgttttctaaaaactgtttcctctccagttccaccagatcagcctcggcttacagtctccaagaccacgtcttcctccatcaccctttcttggctccctggagacaacgggggcagctctatcagaggtaataagatatagattgtccacaatagttgattagttgtgtgatccacatgccaataagtgacacatcttcagcaaatgactggtatgtgttactttattctcccccaaaaatacgtcatataaacaatccctccattacctaagaaagaaaccatacatttatttttaggatatttgttgaaattcaaatcattcatccaaggatgctcatttaagagtgaaatatcaacagttgcaagaaagaaagaaaaaagaaatttggatatctcttttttgagattctaaacactgtttcttttttattttgtcaacacaaagtcattcatttatgtaaccatgggtactgtcctgacttagaaagtaataaaagacagaggacctaaagtgtagatgtaaaacaatctatttgcacaaaacctttgcaattagttcatagttgaggtgtataaacaagattttgttttgttttgttgttttgagatggagtctcactctgtcacccaggctggagtgcagtggcactatctcagctcactgcaacctccgcctgtcgagttgaagtgattcttctgcctcaacctcccaagtagctgggattagagacacacaccactgctcccagttagtttttgtatttttactagagacggggttttgccatgttggccaggctggtctcgaacttctgacctcaggtgatccgctcacctcggcctctcaaagtactgggattacaggcgtgagccaccacgcccggcctaaatgaggtttatatggaaggagtgagcatggtcgttctagtgtgggtggagttaagctagagacagaagatacacaggaaagagggcctgtaccataaaggaggtcccagggccggggagagagaataggggcttagacttcctaaggcagagaacatcctttcttctgagagagaaagaaggctgggaagtaaacaggaagtcaggagcatttcagagtgacatcagtagtgtgctggagcagctccttccagctccgagagtgaggtgccacatcccttcccagcttcatgctcagtggccacagccaccctaagaacattccctcaccatggaaatcagaaatgctacaaatcagagccttttttctcctctccaagaaccagttgttaaacatttatcagcactccaatgggtgaagggaagatcttttttttttttttttcttttaggaaagaaaaagtgaggtgatttttttaaaatcgtggtgaggatgtgtctgtggatttgaggagcatgggataggtttgtaatagctgccttgtggaatgcacagagagtcattaatagatgaaccgagtcattgccaagaagcttgcaaggacccagctgcagatgcacagcacaaattgtacgagtcacaattatcactgtctaatgactttcttttttgttttgttttgttgagacggagtctcactctgtcgcccaggccggagtgcagtggcacgatctcggctcactgcaacctctgcctcccgggttcaagtgattctcctgcctcagcctcccacgtagctgggactacaggcacgtgtcaccacgtccgactgattttttgtacttttagtagagatggggtttcaccatgttagccaggatggtctcaatctcctgacttagtgatctacccgccttggcttcccaacgtgctgggattacagtcctgagccaccacacctggcctaatgacttttctaaatgattctggacagctgggaagaaaagtggatcacagattaccagtaacataagcattgccagaagtctgaagagtgagagaaactaggctccttgttgaaatggcctaccaaaggttccaggctgactagagaaccttcttataggaaaaaaatagggggcacctagggatgggctcgagggaccctaggttttaggctcaaatgaaatgaggcttggattctacaagtgtgagagcatgggagaggtagaacaagaagggtgtgtcagagcacaaggtcttccagatgaagccagttttagtgagggagagtttccaagacaaaggtaacccagcattcctgaaacacagtagtggccaaagccattgccatcatcaggaggtgtcgtaagttgtgtgcccacactgatggacactgatggcactgaggatgatagcaggggacagggaactatacaggcctatcaccaaggattagaggagttttttgaggtggcttcgagggtggaaagtgggaggaaagcagagtccctacaatgtgtagggcggctggaatacaggctgggatgtggctgggagcaggtgcacaggtatcacctgtcaggtactgaaggagctttatggaggtcagatgaggaacacaaaggctcaggaaggaggagggaccctatggccacagaaggccagtggtgagggaaggctgaaaggagtaggggagatactgacaatgacctcagaaggaggcatcagagatgagtgatcgccatgtaaggggtgtggaaatcagcaaacctgcccatttgggtttaggagacactgtagtgtgcagggaaaaaaaatgctttatttttattaaaatggagctccacaggacaggaatagaaggtaccaacccgttgttgcaaacacaccatgttccaggccagctagccagggtggagaaggaacatggctgcagataacagggctgaaggagttaacaggaagaatatttcagcattcacaggggtgaagaacatgggcttcaggctgactgcaggatctgcatcctcctttcagcacttgggactcaccgcttaactgctctggacttcagtgtcccacgtgttctgtgggagagtcgtcactgttccatagggttgcagaaatactgtaagcaaagggcttaggacagggcttggcatggagtgagtgctctagagtggacagtcatccttactagttgtaaaagtagaggtagtgctcatgtgggggaatgaattgttggaggaatttttcaaaccaaagagaagccaggttactgtcagaatagtgggatggctgcaagacttggagctgtttctcctagtgtctgtgaactgtgagaccaggagtacatgaggagtgaggcagttgaagaaatctctactcccattgataatgtatccctttcccagagattcgagtgtcttgcaaaaataacagcttcagcctatgtcttcactcaaggattcaggcatgtatgatctgagggacagatatttggcaacttaagtattccctgctgctcaatatggcttttagaagagaatgagcagaaaacagcaatacttcacagtgataatgtctggtgtggcccaaatgactcactaatcaatacatcatggtgcttctcccaggctgggttacatttcctggaatcagaaagagcgaaaatgttccttctgaagattcttcagttctgagaatgctcgttctattacccacacaaaatgcaagcatcagtccacttcccatagaaagcaaacacagtgctcatgtgaatctttctcattctctgcaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataagtgaaatcatagaagcaaagaccttaggaaaaggtaggtatgccttctcatcgcttcttaatatcctttcttttcccggccagaagaggagattggaatcataaaagatccatcatgttttacgtttatgtgtttgaactttgtcattcctcacatggcttcagcagtgccacggcataatgagagggacagctggaccttccagagtgttctggtcctctcttttattgtttcatttgcagttaaaaagaagaatgtcagtttgaaaatcaagggcgttggtgtgaatgtgaggtgccaaggctgggcagccatgaagcgtggcgcttgccctctcagccgtttggaggcgcccttctcccttagccacccttgctcccaccttcctatcatttccacattgccacatagccaccgcttttcagagggaaaatgatggggtaaattgcgtttgttttttttttaatctaaaatgtggactttcaaggagatgaatcccaaagaaatcatattcagagaaagaggttttgtcccaggaactccagaaggaaggagggatgatgcagctctatgtgggcataggaagaaggtgaggagatgtctttgcaggcttccctcccataggagtcctaccaggtggggtggggtcagatggcaggagagcgagtaatgagatagcaagggtattatttgtgcctggtgccacagttttgggtaacaagtggtaagaggtcaaatgatcggggattgatttatgcagaaatatatcctttaggtccctgggcaccaagaccaagtgtttagttgtggaggaaaatctgttggtgcttcccaaatccaactctgtcttctcttgaatcaggttcatcacatgaggatggaaaaagtgcccagcacactgccccgcaaaccacagaaggaaacccatatgtgaacatcctattgttctttagggaactctaagataccccaaaataacctccacccatgcaattttctgtcacacacccaggtcattacagttggagaaagcctgttggtccataaagtctctattaacaggggacaagttgccagtggcctgtgagccagacttggactgagctcctggcctcgctggaggaagcagtccgagggaaatgcgtgaagatgctgatggcctccccatgtgtcctgtgagctgacctccatgtgccttctcccccagagccccagttctcaaaggagcaggagctgtttgccagcatcaacaccacacgcgtgaggctgaacctcattggctggaatgatggcggctgccccatcacctccttcacactagagtacaggccctttgggaccacagtttggaccacagctcagaggacctctctctccaagtcctacatcctgtatgacctgcaggaagccacctggtatgagctgcagatgcgggtgtgcaacagtgcgggctgcgcggagaagcaggccaacttcgctacgctgaactacgatggcagtaagctggctggctttgtggctctcctgcttgtgtcttgggggatgtgcacgtgggccctgcccctttcccatcgaacatcatctttgccatagtttgaccagtgcccacggagcccattaggctttcgggattcaatggactctgtctggggctccctagttcgttatatccagatgaccatcactgtgtgtccagaaataagagactcagggccatagggagtctcactggggagtcatggggcaggagtgatttctcttagggctgaaggactcttgaccctgtggttctgtgcttgtgttgatgtctatgagctaacattgcttttgttgtctcccacccctttccccacctcatcccaatccacataacaactttcttttttgcactcattacaccctaaactgcatgtgcaaaaacaattttccatggtaaaggagcttatgttagtctctgggcaggagcagggccactgatggaaataggataataataggaatccatgaacacgtgcacacacacaaactcacacacacttgccacttgcatttactttccaaaaactaggtgaggtgtctcttgacattagttaaccaaaaataaatggtttaaaatctcactcattttttctggtatcaagggccatttattgctaactgaacaaatgctaagcccagtgaagctgaaaggagcgagtcctcgactgcaacttagtaggggaactttagaaagtcccagcagcagcgggctgatgctcatttctcactaggggaacagcaaggattgagttaggtgctctaattgcaaggtaaaaacggcagcaatgcatcaggatgagttggaactccagtgcaactctcctcagagccttctattcactgcctgttggtcaggctagaccacagtgttgaatgagttaaccaagaaacacccaaaccctttattgacagccaagccaagaccacgttggaagtgctcctctacctgtgggtgatgctttgtgaggggatgcctttcaatgaagtcactcataactgagggctgtaaaattagacagaggcagcccatgaaaagcatcagcattgctctctaggagagtgattctttctttactttgtgcatttgggaggccgctttattaaagctccagcaggtagctccttggagcacagtttatgccatcctaagaagagtggctgtgaacctaaggacccacagaaatgaccaccaggagctaatgaggtgacattgcctgggattttcatcggaccaatttctcctataatgtccggatggcccagggctggctcttcttgctttggcacacagagcagacctaccccaaatctcctgtccaaggtcatttttccacaacatccttctctgccagagtccagggtcttcctggcacttctggcctgggtctcagggctgtaggaagaccttgagcttgtagaaagctcttctagtgttggttacgctagccggggtccctggcctctgcacgggctctgtcctatggccccagaatagcctatgccctcccagacgacaacttttctcttcaagggctgatgcttttcatgggctgcctctttctaattttatagccctcactcttcagtgacttcattcaaaggtgtccccatcacaaagcatcacccagaggcagaggagcacttccaagctggcctctccctgtaatatggttgaattatttgatcttacaaaataaagaactttgacacttaccagacactttacttagcatttaagggtgcaccaaaatcctctgttaaccagcacacatttgagtagtaagtatcttttttactttagatcattatcttgcaatattcacactctggttcccagcttctctataatatgtgcagatgcctgggcacccagcttaaatgtgcacactgatgatatgctcacagctaatgatttaattagaaactactcatgtgtagaatttgaaactgtgattctaattcacaaagtgttctgcggattttaaatgtttgtcttctaagaaaagatataattttctcactttatccaagatcccaaattttgaaaaatgctgcaagctacctttacgttttggaaatatgaaatcactttattacactaagaaatatggctgcatatttatattttccttgagagagattacagatttctttggaccagtctcatgaatggatagcctctattgtcacatctgcctgaagaactttgttatcttgagaaagccaagattggcagcctacattcataccactcaggtttcagagtcctccatttaatgatctcactctttcttctgccatttccttagccgaatgtttctgcttgacctagtgttgtcttggttttgcagacccctcttcatgggcatcctgtaagtgcctctttcctgaatttctaagcatttggagacttgggcttccacaaaaacactttaaagttgggagaacactcttctcagctttagcagagatcacagaggaacgaggattccattatccctgctctgcttactaaatgcaggataaagaccgttttgctgagggagaaattatattatttttgcattctcttttcctgaagtgctgactttctggcccttgttgtacatggaaagtgcagtggcgtggagcatcttatataatggagggtagcaaaatatatacctcataaaaagtggatgcctgtgtttagatctctgcacccacggtactgagcatctggatagaaggcagcttaagatagctcagagttcatcttccttcagtgtttccttattactcgaaataatctagattttgtagcactatttaaccatgcctgatcaaaagtaggctcctttagaaacctagttgggtcccctttgaaaagctgtctgtagctcttgtaccctcaaaccacagctgttgaagtagatttggtcttacacctgcgataaaagccagcaaattacctaatcacaagggatttgagtttctttatgccagtgtatctaggaccctctccctgcacacgcgcttctgtccatttgcccaaccttttgttcattctttgatgtgcaattttttcgaatagtctctatcaattgtactgtgggtgacagtcaagggaacacttaattctgggtagatgcatgtggcttttgtcagcaccaagcctgggcctcatgctttcaagtgcctgcacactgtagtgcattgcaaaatgaagtccttttcaaacgtgcactatagaataagttggaagttcaggcagagggagggaaataaataagaaaaaaagttagccagggcctagagacagagttcttttcatttctcatcacctccaacacccttggatcacacagcgcgatttttataacctgtcatccctaaaagctccgccatgccgtcttcattaatagccatctaacaccgtggccctgctttcaggtacaattcctccactcattaagtcagttgtccaaaacgaagaagggctgacgaccaacgaggggctcaagatgctggtgaccatctcctgtatcctggtgggggtcttgctgctgtttgtgctcctgctggttgtgcggaggaggcggcgggagcagaggctaaagaggctgcgaggtaggtccaggcccagctgtccacctacgcgtgtcccctgctgctctgcagccaatgggagagatgccagctggagaacaaacctcaaaagggagtgactcttccctctttaacccaggtccctccactgcctggttctctgacattccttcagcgagactgcagagcctcagggaagagcaataagaatgttcctatctcggtcagaaatcaggtgaaagccaacctgtcccctaaatcctagctgttggtatgcaaggaaaattaattttttaactctagtctcttaaattttcagtgggtccagcaaagccaccaattgtggctttctatgaaaagatctatcagatttgctctgggaatgagaattacttgactgactggaagtggaaattgagggcttaggatactggtgaagcattgtgaggcagaggacacatgccatcccaaattagaaacgggagctgaagcccagtgtaagagtttcactctaatgtagcaaaaacataatgaaggctggagaagccaggccagatgagctccattgtgaacagacaccatgattataatgtccagccccgtgtcgttctgtgatgaggctgttctcagcttctggccaagagcccttacttgcccttgctctgcaatgtgaggacagggagttatttcaaatatgaaactgtgcagacgtgttcccaggtcctttgccctttaccagtgagggtgtttaactaagccactttttcggtaacgtgtattacaagggattttcattttaatatcagtgcagtgtgggatactgctatgcagcatcctatgtgtgtttcaaagttatgttcaaagtacaaatctggaagcactctctcctcaaaacatatcccaaactttactgatacatttagaaaacgttgacctcttctgtaaatacttaatttgaccataatccacttagagcagagaacatggtaatattttcacctgtcttcacttatccaaagcaccaaagcactgctttttatggaattctggtacatttcactatcaacttgcttttgctctgccaacaaattacaattctgaagtacattgtacttcatctgtacaattaagaatctgtccatgtaaatctcctgcagcccaataattcaggtcagccatcagtctccttgaaatgttctttcgcaatcgtgcgaaccaattatcttttaattttgcagacattacttgagtgaatgctaggtgcttaatacacaaagatgagaagaaagagctttctgaactctaggtttaaggtaggaggtaggcccataagcagctaccagtgaaagacaaaacatgtcatgaatacagaaatagggcttcaaagaaagaccgcatcagtgaaaaagaaggacggattaatcccaagtggagaggaaaagggaggctacttcagtgctaagtaaaacagaactacaagcgtataatacagcccattatggtgagaagttccatataatgtggaccatgttgaattccattcagttcatcactaaaacacaaaaaggatgttttcataacccttgttcacagtggcctggactttaggagaattattatgagataccaagggtgtctttccttgttaccattagacaactatgtctaactacttgcatttagaaggctgcacattgtctgtatgatgtttctaaaaaccaatagtaaatatttcttattaatgattttgatttaatcacaagagttaagcatctaggtaatgcttctcatcggtctacaccctcgccaaattcactttttcttcttttccctgactcctattgctctccatccttctcagctactattttatttttcctactcaccttcgaacttgagcaccccagctgtgcatttcctctcgctgagagcacctccagttaaaggtgctgtgggctcttactgagtgaggcctttgggttgaaatgatgacccatgcaccctgtatttgtattcttagtagttccttgtaatttaattgttgctgtacaagggctatctccagaaaacatcctggggctggcatttttattgttggcctccctgcttccagacactagtgttttgcagttggttttggtaaagacagcagtctatcacctcagagaacatggcctttcattctccggaaatagttttgatttctatgttctggggaaaaggtaaatccaacacaaaggtttcagtaggaagaaagtaagtgctgagggaaagagggagtattactaagagatgttaaggagcaaaggatttcagaaaagtagcttgccatggcacaaaggtatctgcagttcggcattttgtacatggctaataaagggttctctcaaatcaagaatctgacaggagaggccgggtgcggtggctcacacctgtaatcctagcactttgggaggccaaggtgggcggatcacgaggtcaggagatcgagaccatcctggctaacatggtgaaaccccgtctctactaaaaatacaaaaaaaattagccgggggtggtggcgggcgcctgtagtcccaactacttgggaggctgaggcaggagaatcgcttgaacctgggaggcggagcttgcagtgagccgagatcccgccactgcactccagcctgggtgacagagcgagactctgtctcaaaaaaaaaaaaaagaatctgacaggagggcggtcaggatgccaaggattgggtacccaatttcacaccacttctgaatggcaagttttaatgtagacacactgcaataaattcagtttgacaaaccactgtagattatctaccaggtgcaagatggaacctttttttaaactagtggtaacatttgctggttgaccatttctatttgatcacaagagtttagccaggtcctagagagagaagagatttctaagactcagaactataaaggtgacattgtagtggcagtgggtcaaggcttgcaaggggcagactcatctccgtaactgtgcaaagcactgccataaaaggacagcgccagaggtgagggtggtaaaggggaatcgatgaaaggtcaggcattgccccagaaagacgtttgtttcttagccctgcagggccctgaaatgttcattaatgatacaaagtattttcaactcactcatggagggaaattgcagctgcagagtttaaaggaataggtgcctgtctattaaatatccggagtgcattagtcgaatcacccaataacaagcgaacccacataaggtacagactctgtgcctctgggagaataagttcaaatatatttacagactctacagacagaatattttgattgtcaaaattaaggacaacatttctagtaacatgtcagtgttgcgtgagcaaccatctatcaggatcaaaaatggaaataaggagatttgaattatagaaaaatattatagggatccccagtggatgtttttagagtgattaggtgggatcaattttatatggttgaaattgatcacatttttcaattgctagaaacagcaaaaatgtttataagctgagtatgttttactgtatagacaagtaacctagttagatgaatataatataatgttattttatgtaaaattttagaaagaaagaaagaaaatgggactctagcagtgtcgtcaacctatattctctcttcctgagtactttactaattttagagcatggcgacctcctaaactctaaattgcctgcaagtgcccacatttttttttaaatctataaccttatccaggagttcaggagccgcattttgcttttaatgatgccctggtttttcttgaacttctagatcctttgaagtgcaaggttatagagtgagtcactggttgggcctgagatcccagcagccctaaccttataaaatgtgatcccgtgtcaagtaatcaactccaatatttctaaaagcctcctcctttggtacgcatttacgcaagaaggcacaagcttctgttggcaccagttagtgtgggtcaacctgcaggacttcaaataagctaaagataaaaatcagtgagtgatgtcacatttgaccatgcttttgtggcagagtgtcttgcttctcttgaatggaaatgtgtttattattttaaacatgctttgaaatggattgttacaaaactgatcaattccggaagagactgttcccagagaggatctgggttcatggtgctatgcaggcagattaaggggtaggttatgagaaatcattgttattttctgagtactaacaggacatttatctgctctgcaaatgagcccaaagctcccctcatttggaaaaccaaaaggtaacttgaactttactaacctaaagcaggaatgtgcatccaggaacccagtgacactcagacttgagatagactcaaagtttcaatagatgccccagcactaatgcataaagccaccctgaatgtgggaagcccacattgttaatgcatgagtagcacacatgcaccctagagctttcgttaccaagtgtggctaagatggcattagaagcctgtactctgaaactctttagttctgtgctttgtgttttctttctttctttctctttgtctttctttctctttctttttcttttcttttcttttcttttccttccttccttgcttttctctccttccctccctccttccctccctccctccttccctaccttccttctttccttctatccttccttccttctctctccttccctccctccctccctccttcactccctccctccctccctccttccctaccttccttccttcctttccccttctctctccttttttctctctctccctctctctttctcttcctctctctttctttctgtcttggtttcttaatgaaattattctcttaaaacatcaaacttgttatggcaaactgaatagaaaaggctctctgcatctgacagcgggaagcaaaagagcatgggggtgagggggagtcgagggctaccagtggaggggagccagggagtgggtagtcaggaggggattgtgggtctcagccgggccctggagctctgccttgcctgggtgtcctattttgtctgtgtctgtgcatgcagttttttcagattaccagtatatatggccttctttttttaatatatgtctgccacagttttcaaattagctttcatctgagcattgtgatgattggaagtcctatttgggatcttataaaaacataaatgcaggtttatagcccttgcaaaaatagctactttatgagactatttcaattccacagaaaggcagggactgttgagggagaggctgcaaataaaaccttttgatggatggtaatataaggtcaaaatctgccaccctcagaaagtttttttgtggatatctgcaagtgactgcccagtagaagtattaacctaagcgtcttccattttacgtaactagaacttcagatatgaaaatgtagccatgtggctataaacaagatttctcttttttaaagaagcatttgagtgtgcaaaatgtgaggcagttcagcctctcaagctttgcacagctgcagtgcctggggccatggtgggcactctcccacgccatgctgtgtcatgctctgccttgctgatgtgcaccttcatgccaggcacaaccccaggatgcaagctgtggtctataaacagaacacaggaactgggcaagaccaagctgggagcctcctcatccaaccagaggtgccatttcccaaaactcgatctaaccatgtactaatccacaggctactaatgcttcccattgtttcgctcctctttcttctccatagtacttcactatacaccatcctgccttagtctctcaatagccatgcaaaatggttgagtatgaactgcccattatgatgccccaattttctttcttttctttttcttttttttttttttctgagacagagttttgctctttttgcccaggctggagtgcaatggtatgatctcagctcaccacaacctccacctcctgggttcaagcgactctcctgcctcagcctcccaagtagctgggattgtgggcatgcaccaccatgcccggctaattttgtatttttagtagagacggggtttctccaagttggtcaggctggtctcgaactcacaacctcaggtgatccgcctgcctcagcctcccaaagtgctgggattataggcatgagccactgcgtccagccatcataccccattttctgacgtgaaaactgaaggccagctatagaattatccagaatcacatatgagtccaggcagagctagaagagagttcagatcaatctccctaccctactcctcttgccatgaaacttctgcaggattttgaatattcaagtaagaaacaggttgtctcatcaatattaagtaagctctaaaggtttatcaattatacctggaattagaagatgtattaacacagtatcaatagctactatataattttatgtttgcccatcaaaaatacttggtctattgattttgtatttcgatattcactacccttcagccttcccctaattatattttaaatatgtatatattatatacagagagaggcacatatacatattccttctagcttgcatatcttcatcctactgtctctctgattcttttctccactgaatacttgagagtattctgtcctcagctacactacctctcaattactcccaaattcccacagtccccttccactcgccacccaaatgtaactgttctcctgaagacagatgaccagttattctctgatctccaaattatcctttcagccatcattttttagccctctttgcagcattcagagtgttagcaaatgttgtcttttgaaattccttccttccacattttaatatcactagattatcctggtatcatttctccatcatttcccagcccaacagataagggaggagcccagagccaaggatggaagtgtgggagtagcaagcggctttagaaaagatgtcgcgaagtctgaatctcaggctgatctgaaatgtgtgggaaaaaatgtgacaggcaatgcaagggctgtttagctgtgtttgggcaagaagaacaaggctgtgaacaatgttctcatattaacagatggcaggtagacaggagagctgctcagcatctgctttgcttgatgtgtaccaggagaaatgctatttgaatcagaaaacgtggaccaggaattataaaaagaaggaaggaaggaagggagggagggagggagggagggagggagggaatgaggggagggagggaatgaggggaggggaggggaggggaagggagaaactcaggatgcttatgaaaataatcagcaccctgatagtttaaaaggatttattttttttcaaaacatactctgtattagccattatgtggaggtggagatgttgctttttgcagacaatgtttacaaagaactattacacaagttccaaagcgtaagcagcctaatgcagacagaataaatgctgtgctgtttcactgaaaggaaagatctccaccacttaaaaaattagggaagctgtcatggggttccagtcccatgattctgaaggataacattttagggttctgaacaaaatttttccagacataaccccaagatctttctggataacctttgaacaatcaaatgtaaattagaggtgttagaaaatgattatgcagatggtccctgacttactatggttcaacttaggagtttttgactttgcaatggtgcaaaaatgatatgcattcagtagaaactgtattttgaattttgatctttgtctgggttagtgatatgtgatccattatttttacatgagatactcaacaccttattataaaataagctctgtgttagatagttttgcccaactgtagggtagggtaaatgttctgagcacgttgaagataggctaggctaagccctgatgtttggtaggtcaggcatattaaatgcatttttgacttaattatattttcaattgatgatgggttcatcaggaggtaatcgtaagtcaaagagcatctagaccctggacccattttcaacaacaatagattaattctggacattatagactgaaataagttagttgaggttatagaaaggatgttttgtgagcaatcagggaagggaagggaccaccaggggcccagacaaactccatttgcattttgacagggctgattaataagggtacaccaggatgtagctgaaagcatgggcaggctaatccaatcttggaggccacatacatcctggtggggaagctaatgtattagagggacaaatccacattttaagagattttgaaaggctggaagcaagaagatacagtttaataggaataattgtgaagtcttctatagaagttgtaaaaaaaaattcatttgcaacacgtataatgagcattgtgctctccctagtgtgctagaagatcaagaattaccagcgtctttctcagcctcattttatagagaaataaaaaaatcacaaacctttcaaagaagagattcccaagtagggaattacctagaaatcattccgtatgaggagtggctgagaaaattagagaatgtaacccagaaaagagaaagctgaggccaagcaagggaaatgcagctacatggaaatatctgaacagctggcaaatgacttcaggttaaaattacatcaaggaatttctgcacaagaaaaggaagatgtctctcacaattaaatgtgtcctcaggaaatctttgtgcagcttcactatggatcagggacaggactgtgcccaaaagggccaagagaaagacaacccgaaaacaggtgggcacagtatgagctgggaagggctgtctgagatataaggcagaggtccagggaagcggagggaaccgaagcttcacccctgcctactgggcatgggagggtacacggagcaagttgcgtctgcatggggcggtggggacgatggagggctttgcactagcaaagtcttgggctctctgcagaaagtggcaagtgcaggaaactcagagagaggttggaggttacaagtgagcggcagcggagccggatgacagcttggaccagcacggaaggtgggttctctgtgctaatgagggctgttgcagtgaggtccctttgaaggtttcaaagcacaggtatcactcagtaagatggattccagtcttcacccttcctgcagtgtgggtatcagtgttgggcacaccagcagtaaggatgctgactaataagtgagattaggactgagaagagaaaaaacaaaggttcccctggggacatgctggctgggagagacctgcagacctggaaggcaggagagtactgggaggagaggaaggacactaggtgtgcagcaggagcaccgaccccaaccgtggagtggcagtggccccagctctggattcatgcagacagagaatatgtgtacgtctgtgtaagacattgtgaaagggattccaacattcattaggtggccaatctgaaaagtctttattgctcttaagattctgtgattccgggactttaaatttttttcttggcttgtctcagactctcttctcaccctcaacaaaagtgtgtcccagatgagattttgccatcttctttttgcactctctctatggggatatgaaaaacacccagaccctcatctcagccctggcatctttccaaatttgattccaaatttgcctctgaacagcctcacctaatgtcccccgatattgaaactagacaagtctctcccaagattgctgcttccatgttgttctagtccattcctgtcactcatgttactacatccagctctgcatatcccaaatcttgcccttttcctggactccctgcaactcctccttgtcccactgtacacctggtaggactctgattcgtacagatttcctctatcttcacattataatgttacccacataaccctggctctcttctctaatgcccagagcctctcacttggactaaggactaagaagctttcaacaagtcccaggcccccacctccacattcagagcattctggattgcctggtggatgctagttcacagcacccacacccatccaccacccacctctgccctcctttttcctctctccctttggcccaggtagaagctttcaggtcagtaatacaaagtcacatctccttagctctttaatgtctagactgtgcaccagaccaccatcctggcaacttctctgtccagtcaaattgacctagactttacttctcaaatgggctcataattccgatgcatgtgaattctctgcatggagcacactgcccattcatggcaaagctccccacgtcccatgctcctttaaggtggggtcagtgttaggtttagggaagggttgacccaaacggtcaacccttggcatctagacctgtgaaagaccttagccttggggaggatgcctgcacgtggcagccaagagaggtctgctgtcggcatggcagtcattgtggggagctcttttctccctgctggactccgcaattccttagtacattgccatgaacagctcataggagagagctgtgatgactgaccgagaataggaaaaggagagattattgtggcgggcagaatgaggaaagcagttgatcagaagacaattgaggctgagaactctttcaagtgtgaactgaagtgggatgtttactccttgaatttgtttccccctttttagagtattgtaccagccactgcttggtagttcattggagctaattaagtccaggcttctggcattatatgtatgtgtatatatatgtgtgtgtgtgtatgtatatatatatacatacatgaagtatatataagcacatatatatatatatatactttgtaagtgttaaatcattcagggaaagaggaaattcattatatttactgtgtctttgcagataaatataaagacatgaactgggaaatccaatcctattttgatttcttttctttgctgtgtgggtggagtatatgggccctgtttcattgcccaggctgaacccatctgtgcacaaaaccaggccccatcttggggttaccattgggactggccaacttaacgaactaagcttggctcatggcaaggacagcctctacgtggtcattctgtgactgtccacgtctttcagaaatagcatgctgcccactgtgcagaaactgactacgtttaattgtcagcccccaaaggcatgagatggaaatgctcccacatacgtatactttcactgcagagctggtcacactgtcagctgagtccatttccggaaagttctgttcattgaacagtatacttagcatcaagactttttagagagcaatgaaataaaaacaaaaagaaggtttttgtgctctaagtaaggaaacattcatttttgccaggaccaaatgtgtaaaaagaataaattatattttaaaggaaacgggaatttcaaaataacaccaccaaaaaaagggattttttttttcctacacttttagtcaggattccttctgtcaagagtggtaacccggtcttggtaaacaatgtgctcagagaaaaaaaaaataaagtttttttaatttctgaattcaaaataaacatctaagtttccaggaacatttatatttcatttatacgattctttggtcaacccaaggaactcagagctctgtaataatgccacttacttctgatattttgataacaaaaagcatgggtttgttcaacgtaaatgatataccctcaaaatgttaattttctgactactgaaaataaaattggatttcctagaagtgactgtaggttggaataaaacatttagtagatgtctgagaatgttataatcataggatagttatgttgatatttttgtaattaataaaatacattttaaaagtcccatttagaagaaataaggactccatgaaactctaggtcattagtagtgagctgggtatatgattgtgtttcaaaatgactgttctgatctgactgtagagtatttgtcataaatgcctaagtgaatgttaatgagttatttaccatgtactaatgttaactttctttccccagatgcaaagagtttagctgaaatgctcatgaggtaagaacaagacctagcaccccagatatcatgtttgaaagaacaatttccaacttgccttgatgatttctatttttttaataatggcagtctgaaattgataatgtcttttctttttagaaaaaactgtaatttcctatacattccaaaatatccatgtaatgcctagctgaaggtgtagatgaaaatgatgtatttgtagacatgccacaggtagttgtcttgttggctggacacaaccaatagaaggcttcccattagcctgggaacagaagcacgtaaagaggaagtagctttagttttgccttcatctaaatttactactggtgaggtcaagccttctttctaacagaataatccaagttaaaagaaaagcacaaaaggaatgtgctatgccccatgctcttcaaaggctctgtgtctccatcagcaccctccaccagggcacccttcagctcctcttaccactgtctgttcactgtctattctggtcctggaagtcacagccttcatagttcatcctcgtgttaggagtagccagcacagtagttgccccattcataaccgtggaggggatgaatgaagagtggttattgaatgagtacgagaatgttcacaactgtggaagacagaaatgcatccttcacagctttcctttcacacgtccacaggcttgtgattggcaaagctgtgacaagtgtgttactttcacgtccccaaactctattttccacccagtccccctcttcaaatgttcagttttcttgtgctgtccaacctttttactctgtaaatactagaacactctgatatgaagcatttacacgtatggattaattgcctgatgtgttacctcaccctgatatttgcattttaggcctttcatattgcaatgattacatgaaaagtgaaaaaggaaaatcagagtctaggaaataagtagggaaaatgtcaaggactccgatagtgaactcaacattgccagtttaggatgatttacgtgggagagagagggtggatctaggacctcttcccactcccatcaccaacacatttgcctgtgacttcctcctccatctatacatataaaattagtactctttgttatttaaaaacttcccatgttccatatcactaatatctttgaagaccgaaggcagtagtagaatgccattggcacacagattccatcctacagacattttgtttggccataccgtatttcaaaacaatgtgaatcgtaggtaaaacaatgatatgaaggataagtcttttcctttttcttttttttttttttttgggacagagttttgctcttgtcgcccaggctggagtgcaatggtgcggtcttggctcactgcaacctccgcctcagaggttcaagcgattttcctgcctcagcctcccgaggagccacgattacaggcgcccgccaccatgcctggctgatttttgtatttttagtagagacagagtttcaccatgttggccaggctggtctcgaactcctgacctgaggcaattctcccgcctcagcctcccaaaatgctgggattacaggcatgagccaccacggaaggataactctaaaatacatttgttgtgactgatctgatgaatgttggtgccatctgccaagattaggaagatagaggcaggctatggacttttgatttttttggaaggtaggttgggaggaggtattgatgggaatgaaaagacctatttgggtcatgttgaatttgggattatttttaaggcatccagaggaaatgtcagatagacaactggtagcagaaatctggagctcagaggaaaagcaaagatgcaaattccctgtacagtatctccttcataaggggtacttcatcacatttccaggagaagattacagaaattgcatgagatgccttcagcccgtgctttttgtttatgtgacatttatgggtcacagggaacacatccaaacacacatgcacttgtgttaagcagatctgataaaacaaagatctgcttaacacaaagaagctggaaaacaaagaagtcagagtcacatgacttgtaataactgatctacctaataaaagaaattgtcaaaggtagactttaaaaatatgaattagttgatgacatttaaaatgaggagatttcacataaaatttggctttctgatttctcttgaaaatgccctggccatactagcaccgcggaggtgataatggtgcctggaggtaggcacagtagccctttagaatggcgtgagtttgctcaccaccgcagcccccacccctaccccaccccgggcctgcttcaccagtccgtacactgagcagggctccttcagccctccagagagcttctcctcccctcaactgtgctctgcacaacctaccctggccccctcccctatctactcccaaactgtaaatcatgcctttgtccagaggctgtgaaactgcgggctatattttctgacatgttcaacatttgctcaattaggatgatttgctttttctcttctcctcatattctagagtacattcctactccttctccctagcctctgagaaagacattagcaagcatcctctatgaatagggcagttgctgtggttgcaagaccatctgttgataagaggaggaattaattatggtcttcctattgccagttaccagcatgaattaggaagagtaaagccagtaatcacaaccacttatgatagttacagtggttttccttcaaatggtcaaagtgattgaaaaggaagagaattttcaagctcctccaataggtggatttgtatgggattaatttagaagtaaaagcaaagcttttacccatgaaaggttggttcaatctaagttcggcaggtgaatgggccaagcaaacaaaaacctcattacctaactggtcaatttagaatcaaccatatttggacatggcccagggggtccagacaaatcatgtccactggcagagagaaagatactgaacagctacccctggtctgtgttgctgttttctctagaagtcaaaggaactggcagcctggtacagtgagaatacgaaccacaagtctgtgctctaggccccatgtggccataagctggttttcagatcttagtaggtcattttaccgctttgttttccttacctaaaaaataaaaataaaataaaaaattcaacattgtttctagctttatcactccacattctgtgttctaaatggatgtaacatttatttttcaaccattttctaccaagaagtatctgcgtatttcagggagattagctgagggccaggccaggaaggcagattggacagcagaacatacccactcagtctaggtccccagggattcctggcctggcagcatcacccattgctgggcttcatgctcctagatatccacctgtttcacccatgcacatcaccccagagaagagagactgcatccctcacacccagacagaaagattgtccttttatatttttatgtaagatttttatttttaaaaaacagccttctaagaggtgtttgctccaaagagataactgtatactgtagagagctaacatataatgtttaaggtccaggaatcagcattagcgagtgagttgggtgtaagcagaaaaaggttcaaattagttcagcttttttgatgttcatatttttgtgcacataataaaaaatctctaccctagtgttataatgagctatgctcctaatagtccaatagtcattgtacatttaaggaatgttctgtgtcatatttgggaggatgatggactattaagactttgaagagtggcagtggctgcaaataattgattggctaagctgggaaattctctgccctatgaaaccgtctctgctctcctcttcttctcattttattcaaacaaccagatggcaaataaatggatggttgaagattatagctcaataataactaatatgtttagcatgatcctatgccatgcaaaaaagatgcaatttttgcttccacagtgaaaacatttggactgtttttccaggttgcaaatgaggtttgttcaaatcacttttttaaggtttgctgccattctaatgaccaattgttatcatttttgaggttaacagaacacagagtgataaatataaatgtaacaatagattgtcaaaagtgacagcaaatattaagtaatgaaataacttagttggaatccagtgaccttttagaatgagaaggatattattgcctcaaaacaaagtcttggggacatctcactcagctcacgttgtgccctcaaaataaatcaatgtgaggatttacttcacagatatttattgagcacctactttggccatatactgttctaagttctagggagacacaggaaacagagcaggtgaagaaaaccctggtggagcatattttccagtgagagaggcagataatggataagataaatcaactaagtatatgctagagagtaataagtgccaagcagacaaaattaaacagagaatggggacaggacacagaagacgtccccatcgcagggccagcctggctccactggaaagatgatggcatctgagtccagccttgcaacaagggagccagtatgtgggttttgggggtagcaggggaagtgtgttctaaacaacgggaacagccaagtgcaaagagaaagaagaactgtgagtccggccaggcgcagtggctcacacctgtaatcccagcactttgggaggctgaggcgggtggatcacgaggtcaggagattgagaccattctggctaacagggcgaaacccggtctctactaaaaatacaaaaaagccagacatggtggtgggcacctgtagtcccagctactcgggaggctgaggaaggagaatggtgtgaacctgggaggcggagcttgcagtgagctgagatcgcgccactgcactccagcctgggcaacagagcaagagtccatctcaaaaaaaaaaaaaaaaaaaagactgcagtgaactgtgattgcatcactgcactccagcctgggcgacagagcaagaccctgtctctaaaaacaattagcttctgaatctcaaggcttgttgggccgttttcttatagtcttctgaggaggaagaatttacctccagccttggttgtcctggttcgcagagttgaatcaagttctaaatcttggtgccagccagtcgcagtggttcacagccattatttagcctgcttcctgtggcaatctggtagcagaccccttattgttgtttaagtatagcctgcacttggtgttcatcgctatttaatagagcagccgctgactgcctcataactattcatgaagagcagaaggaactagctcacacttctatttttggtgcaaggacaagctcaagtccctagtgaggtttctaaacagatctttgggatattcacagaggagtagttccccatatgtttttgtggaaatatagcttgtctaagcatgccgtaaatgcagccccccaagtaaccaaaatgctcctccttttatttgattatttgaattttttcattactctctttttaacaaaatcaacgaatgacaagttagttaagtcagtaatttgaaagagcttggagaccatgtgaaaagtcaggacaaaacgtttgaatttgggctctgcataattagcatgatgtaggtacatagcccagttccttatctgcagagcaagcaatctggttcaagatcaagtcctaagtaggaatgttgcacctttcagaagttgtctttttcatgggataatttgcttttactcaaacgaggagtatacatggatctcatcaggcaaacatctaagggggtacttgagtgaccttcactttgggataattaaagttctgtccaccacttggtttaagagtggatgagtcctcattaacaaggaaggatcggtggaggcacagccctgggactcggggtaaatggctcggttagaggggaaagcatttaaaatgtagcattgagtattcctattttggtctccactaaaagtaacacagaggtaaaccattattgagttaactaggctccagaaatctttctcaaaaccagtgttaacaacaattgagctggattgatggatgccatagattatgccattgattggattatccaagtgactgctgcttcttagaggatgcttcagtaaatactatttgaacatctagtaaagtcttattattctgtaaagactgaacaaccacccttctaatgtggattgctaattaaagtctttattgacttttttagatttttgtgcaacgtggagttttttttttaactgcaggctataactgaatccgattctaccatgcagttttactacttattttcatttacttttagagaacagctcactctaagagtaatcttctgatacacaaattttgagattaaattatgatagtaattgctttttttccattctaaaatgtactatcagttaggaaaactaacgtcagggaagctaacaaggtttgtgatttgcttctagaacaaaaataaaatgacaccagatataaatacaaatccattagtaaaactcccatccgacaaacagctggtgcacgtgctttttccctcaccatctttggaatatctggtgctttattcctcaccatcactggaatatctcacatctgacaaatgaaaatgctgttggtttttaattgcttttcatttgtttcatttagcatttacacaagaaatgagaactttctaaagattctattggtagatatagagccaatctctattgacaatttgtattttctgaaactctccagccagctgaaatttaatattaataaataaataacatttgaatgaaggaaacgttttcatagtatgtacgttttctgttcccctcctcacaaggtatttgtatatttagacaataaactaagttggtatacaggtgcatgttggtagaatgttaacactgaactggatttgttaatgcattaccccattttattcccagtaagaatacccggacttcagatacgttaagcaagcaacagcagaccctgcgaatgcacatcgacatacccagggctcagcttttgattgaagagagagacacgatggagaccattggtaagctgccctatttgccactttacacaaagtggctgccacagccatgccttctcaatccaaaccccaggatgtgggaaatattagacaggagagcgtcttgaaggctacgtgagtaccaaagctagaaggtagagaattgttcttgtgaagaagaatcagtaccagcaaatgtgcagaaaatttgacttatatataccaccatatatgccaatatgccagtcagttccaggcatttgggacagaaatccctcagctctgatccatttgggatctttccaggggaggctacggatgccactccaaggaataaacatctgtaatcgactacacatcaatccagaaggcctgcactctaaagccccaggttgaaaatccactccgtgcccccctcatcaactctgataatgcaagccttcattaaataaaacttttaaactgtacttaacacttaaacaaacacatgtctttgtacagggtatcttcccccacaccagtgccccagaaacatcctgcagctgtttccccagcagcactttgggaaaaacaccagggccctagttttagggtttcagaacagccaccctgaggttttctggcttgttcaaccagaacccaggtatcttcactcttcccagcctctttccacctgaagtccattaccccacactgcctgcctcgattattctatttattccggagtgaaataccttatatttcctttccagtaataatgagaagaatagctaacatgtattgagaattctgtaaatgtcacatagtttttataagcacttcgtgtgcattacttaatttaacctttcaaccaacatatgaaagaagtcttgcttttgtaaccaagatgtagagaggtctgtgtagctttccaaggtcacagagacaggcgcagaaccaggttccccacctggccacactcaccgccatgctgtctgtctccaatgacagctagcacagcagcaggccacctgcttccacaccaacaggctgcttccaagaaaccctcaaccagaagttatccaagcttttgagtgcccatggaaacaccctgaggcaggctccgaggctgcctcttttcaaacctggctatgtttgttttggaaggtgtttgctggcatgagtcccaggacaaccctttcttgtggtctggataaactgcctgactctcagcacatagcccagctgcctcctgccgggaaggcagtggtaagagaccaggtgggcagaacacctgctccatcaaccatcacccttctgctgccccacccaccactggagacatcttgacctaatggctcctaaattctaaggcctgggttctcctggctgaagtcacatttggtccaggcatagcagcacttaaagattggtcaagtgcaaagtggctcttgatcagctaacttcagtgaaacacttcagttaaaccatgtatgtgaggtggcactacctgccctaaagtacacaagattttattagcttgcttgtatcaggacaagggataagctactatgttttgcttttgattatctttttttgggaaaggggaaggtatacctggaatctcttttgtttcacccagtagattgggcattaaaactgaaaatttcctttgaaaaaatttcaaaaattagaatgtaattcctttgaccatataattttataagccatttatatgcattatttaatttaacccttccagccaacataggaaaagtttcttttgtaactgagacacagagaggttacatagtttgtggaggtcaccatggttatataacacgttacaatatttgctaaatgcgtctcactagacaataatcctacatatggctatgaaaatagatagctaggcagatgccatgagtggtctatggccttccaagagctggtcactggggggcttaacaccagaggaagcctgccagtcatttccatttgtaaatatgaccgttcgccagagatccatcccagtccatgcaggatcatgtatcagcaagagcccttgacctccttgtgatgcctgacaatgggtcgatggcattttctaattactgggaagtggaactgtggtgcttcaaaatgctctgggctctgaccacaagaatccaatattacagtgacattaatttccagctagaatgaatggttaacctcatgatcagacaggcgcccaaaattttccatgaaaagtgtgtaacctagccccgcagatcatctggtgtgatctaaaagggcctgcctgctagaaactgtgacatatcccatcattaatgaaaaacaaatgtagacacggagcctctcgtgctgggtccagttgtaggaagctgtctctgtggaagagccaccctctttgaggagtcgagtgaccgccacggggccggacctccaagccaagcccaggcgcctgctgtggtgccaacctcaccgcaccatgcgctgggatactcacagacatcttggcagcctttcctctatttctctgccaggaaattttattctaactttgagaggctttcctttcctgccagagactgagtaattggattttgtaaggttcattctgttcagagccttttttgggcacagaagtcgagctgtgttgtttacgactttcgcatccctgttgcagtgtcagggcagggctgcagtatggtccctgctgactgataaactcttagcaacagcatcctgggctgcaatctttgaaaatttatgaaaaatctgtatatcctagccaaagtctcccttggagtaaaaaagctttttaaaaagtatgaaacatatcacaaggtagtaatgagaatcctggcccaccaaataatgacccagctcaaacagcagctcctgctccaagcactaagatgcccagaacccatccaaacccaggctcctgcctcgctcaccttcaagtgcccacggcagtaggacttgggaagtctgacaagtgaatcatgtaggagaagtcagttaatggatgttctagagtgcttaaagcttacaggaggtgggaagaaaaggaacataccttgagtcctttaaaatagagcaatcaataagctctgaagactggcatgttttcttctcttttatttcccctccaaacattagccaagttcagaatgagagcaaacctcagtagagagaactgtagtggcgattttctagtcctgcaaacagagcttcccagcagccaaagggacctgtcttcattgacagcctcatcactggtgagggggctggcatcgcagatgatgtctcagagaagcttttgacaaacacataaatccagagttcaaatcaatgttagcttaatgaaaagccaagcccaaagagaaaagagagctccttctctgcatagtcatggttcttcttagctcattgctcccaaagccaacccctaggaagaagcttctattcctagcactctagagtaatgctaattcagtgcttgaattttcaatcatttttgtcactttagatggggctattattgtggttgtcattaacaataacacaagtgcctcaggagagaaaaggccagggagtggttggaagggagataaacgtgtttggctttctgtgttcctgccatcctgtagatgatcgctccacggttctgttgacggatgctgactttggagaggcagctaagcagaagtccctgacggtcactcacacggtccattaccaatcggtgtctcaggccactgggcccttagtggatgtttcagacgctcggccgggaacgagtgagtggtcaacaatgcttaaaatgtgtgggtgttaacaatgctgaaaacatagtaatgttctttctctctcaaatgaaaatgtgtggcttttcatacctatgcctgagaaacaaatgggtataataacatccctaattgggataatgagctgttattgatggatcttggctattattatgtcagttgaattactgttagtattggttactataaaaagtgctagaaatttcaggtacatgtatttatttttttaatttaagcaacacagaaaaggaaaaaagtaatctactttagtgtgtatctgctgtatgccagtattgggatagaacgatgatgtcatgcacgttatctttgcaacaatcctgtaagatacctactcgtgaagcaggtatcatagcctctattctgcagatgagaaaactgcagcctcagataaattatgcaaacagtataaagttgcacacataagtagtaaaaccaagattcagaaacagacccatctatccccaaagcttatgcttttgcccctgaacacactgtttgagaaaaattataattctagttaatgtgaagattatgttggattttgttattaatatttgcatccataatatatggaaattaattactgcaatgaaggtgaatcccctaatatgtatctagagcttattaattagatactcttatttcttcataattggaatcgttcctaaatctctttaaagactgagaaattgatgtcctgattattatcattttggaaactttgacgtctagctttcaaatctctaatcaatttctttgcaaaaatttacattcttagaatagtgtgttattattagaaaaataactattataatgttaaaagctattcttcataaatcctagcttgggaagcatttgcgaaatgcagtgagctttatgaagtaaacccattgcctacgaaataacattgtaatatacagaaaacagtttcagcaggcattgaaattcatttaaaaaatgttttcaagaatattctacattctaaagaagtcttttacctcttccttttgtctaatcttcttaccgcctttcttctttgatcacattaatacattctgaagacataaacgggatatgagtgggaattagctttgcaaaggggtgtgtgccagagccttgctcttaaaaaatgatccagactgggcgcagtggctcaatcccagcactttgggaggccgaggcggtcggatcacgaggtcaggagattgagaccatcctggctaacatggtgaaacctcgtctctactaaaaataagaaaaattagccggcctggtggcgggcacctgtagtcccagctactcagaaggccgaggcaggagaatggcgtgaacctgggaggcagagcttgcagtgagctgagatcacgccactgcactccagcctggacgacagagcgagactctgtctccaaaaaaaaaaaagattcaagggctttgacatctcttcagccgttggcttctcccttgtgaactgcctggtgtggcttgctgctactccaagacactgctccaatgggtttaagagccacttttttgctgctaaatcagaaaaagttacagatattgaaaggattagatttttagagtgatgcagcattggcttcagcattctgttggaaacggtggcagaagagcaggcaaaagagacaacagagcagatgccctgggtctcgttctccacctttacatgcatcagaatcacctggtgcctatttaaatatcaattccaggcctccacccagagattctggcctaggaatccgcatggtaacagacaccctgggtgattctgatgctggccgtttggaccccacattgagaaacactgccccaagggttagaaatgtttcctgcatgtaacgcagcagggcaggacccctccggcacatcagttcttcctgccaggtaaaaagcaacatgcatttctgcttccctgtcaatggtcagctagcagccgagaatgcataaagctagtcataaatagttaagacaggagaagcagcagcccaaaacaaaagcactggcaaccttccagcttcatggtcagccccagaataatggggaagttgatttgttggcatgtaaaatatcaacagagacatgaaccggagtcacagcagatactgtaaaccagtggtcagcgagtgccaggcaggacgcacatgggagggacgtgtgtgtatctcatggctataaagttggaagcagggctgggaatgttaatgcgttcattcagcactcaaaagtatttattcaggtttcactttacgtatatggctcagtgctgtatgatggagatacaccatgagtaagatgcaaaaagacattcatttcatcctagtcagggggcagacattagacatggaactaaagtagttttcatttctcagtaagtcctagacagaaagagaatgaagccatggtgagtcagcgggcgtgtggagcagtgggaggggctctcttgggtccaagtcattcaggaggacttccagtgaggggaagacatgaaacaagatcagagtcacagcaggagcagagggggcagcagggaaaagctcccaaggttccccgcatgatgaggatggaagtggcactggagcacagtgaaaggcagggaaaaggtgagacagagaaacagctgtcctcatctttcagggtcccctaagccagtgcctggcaggtgcatttcattctgagagtgctgagatgctgtccctggggcttagcctgatgatcacagggaaacactatagcttatagaacaatgtttctgtcctttgtgctgaatttcactaaatgatgtttaccaacatcaagcaaatctactcaaatgcatgcatcagtctctggttcccccctcactctccaaattgagcgtattaatttagcatttgcagaaccctctgtattagtaaaagatctgctggatcatttttttcattaaatcttcctcaaaaaccacagtgtgagggactgacaacactccgtgttttatttagagttagaaatggtaggtgactggccccacagtgggttcaagagtctgaaacccatgaactttctgaagcacagtcccccactagcttcttgcaccagagcttctcacctctgcccaggtgtttatacctctgtgaattccatggagccggttcttctcaccacagtttggcatacttgcagagaatcatttgtattctctattttctcagctagagaacacatcgtgattctattttgtatgttaggactgtgttgtcattgcaagaattctttatttttaagaaaagcatctaaaacatgttgcttgcataccagaatgactgcattgtagaagttatgtttctaggcattttattagtttgccagagggttgcaacagattcttatgaggatggaagaaatcataacaatttgctatttatctctgtcagtagtgaaaacacatcccttggctggttctgctgcactgattacttctctgtctttcctgtggattataatacactggaaaactaggactctatccatgtcctcatccccataccagccacagtgtctgacacaggcatgtagtggataaataccaatcagccatcaagttctgagatcagaacaatgggaatggaaaagaaaagacattgagtcatgtttgctgcataggaatcatgggcacggccagctgtgcctgtgccatgtgcccggagcacttgggcacattaatctcatttaaacttcaggacagctcttaacgtgggtgatgacatcacctagtctcagagactaggggattagtcaggtctgtctgacaaggtcacttggccagcgacacagccagggagtagtgaatatgaacttccagcccaggcagcctaattccaaagctctcactctcagtcattctacatggcctttaggtagagatactacatatagaatatgtagagactaaagaatagacttcacatgtacgcacattcaatgacaagagcttacaacatggacttgaatctttattgctgagactttgaaagaaaaaatgccctctgttacccaggatgggactagcagtggccctgagggaaatacctggggtgggtgaggtgcatccagtggtccaggatgtaataagtgctagataaatattttttagttacatgagggagtgttcagatctcccagtttcatcctctctctgagacaactagtaaattcgttatgtaaagctggacctccacaactgcaagatatggaaaccaatggcacagatgaaagcagattaataccatgatcacagtacgcatgacatgttctgtaacctattatattatctacaaaatcctctctcatcccaaactcaggataattaaaataatctgattcaatgggcagaagcttaattagggttcaaaccccatgttgaaaggccatgagctatttatatcctgtgccctccaactcatgggctgctgagcaggcatgaagcttaatcaccgagttttatttatattagaatgctgggagcctaacaaaatactttccatgaaggagcagtaaatcccagcgtttatttgctcagtagatgagctagtaagttacacaaaaaaggcttcctgtggaatccaagtaaaaattatattttagctgctatcttagtcattatcatacagcagagttcagttcaggtacaaaacaatggctccaaaaaccaaattattaaaaaataaatgtgtcaaataccccagtattctacatactgaggcaattttgaccctaggatgcctgcctagcgcagtacagaactgagggctgtggtttaaggaaactaatatcatgacctaaattttcaacattatcaggccaccagtaaaactgtcctcatctagaaaaaaagagattatgaacaaaattaacttgaaaagagaccaggctttgaatcaaggctgcatgtgcgactttcccatggaattttccaagtagggtgatctcaatgaggaaaggggctatgacagtgaagatctttgccccaccattggagagtgagctcaagcagaagaaatgagggtcaaggtttgggggattggaggaaatgactgtatccttgaagtgggactagcaaactataccccccaaccaccccccaacttccatgccagaagtaaacctgctcagaatgagctacaacagttgtagttgcaagaaacttaaagaagaataaaaatgagaattttcaaaacttatgtaagggactgggtaattttctggaaaagactcattagcatttaaataacaagcttcacttatttaagctccacttatcaagtcgatagtgcctggaagacatttagcctcttccccatcataatgtttttctgtctttttgagggcctctttcctagcatttcggtgaagaaacccaattatcattcatacctggttgtgtagagctccaacataactcatttacattctcatcaaggacaaaaaaaatctaatgaagtcttccgtggaattgtgcaagtaagggatgaaatgtgtcttaaaatcaatgccccagagaatatttaccaagattgagtattctgatgatttaggagatcttaaaatctatctctttggctgccatcttaacgcacctctccagcgacacagaatgatagattagattcaaagtcgaattaactagaaacttgcagtgaggaaatctcccgtttaaaaacaaagtcattgcaccttcccagtgttagcctttcacattccaacatggaattataagcaagccaaggtcatgtagacacagcactaggaaacttagacactcaggatttggccatatgtggtcaagtaacaggcgttatctgaactgaaaaggcagaaggtttgggttatagttttatcacgtaacagctatgtcacttctctctgagcttccattgccttcataaagtgaccctaggtctatgaattccttcagaaaactctgtatgtcagggattattgtaggctctatgaatggatccacagagggataccattgcccctgccctggagacactgccaggctcatgaaagcacataaataaatcggtgcaataacattacaggccggccctgtcagttttgctcctttgaaacttcgtgagagcccaacagtgaatacagtctgctgggtttagaagtggccagaccatactgaaatataactgtatcaaactgctctttgagaagcagagaattcaaaggtagaaaagacccatctaggaccttaagctgtctccaggctggagccccagaaaaatcattccaggtaactgaacctctctcattttccacagaattccagaagaggcgatgttgtagcccattctggtacctgacagtctctgctggtggaacatccttcttcttacctcaccaaagggttgagctaagaactccgtccaccccatagacttgctgcctttggttccagatttagagaaaatgaaacccatctggcaccagcttaaccctttgttctccatattaaataacccaagttgtctctgttaaagttaggacaattctattgaagagatgtgctatcataggcaaggccttaaggagagttgggacataaaaatatggtccctctgctttaggagctttcaacttaatgaataaaacagtcatcattaaaacaatgagtagtaatatgagaaacaaaaatacaggcaacatctgtattaatttcctagagctgttttaacgtagtaccaccaaatgggtggcttcacagcacagaaatgtatttgcttgcagctgtagcactccagtctccacctgcatcatcccatggccctctcccctcctgtgtctgtgtcctcttcttaaaaggacaccagtcacagtggattaagggccaaccctattccaatatgaccttgtcttagctaatttcatctgtgatgaccttatttccaaaccagatcacacattctgaggtcctgggggttaggacatgaacatgtcttttggggggacgtgattcacgcataacaacacctaaggatgtagaaaggaggtcatgttagaacacactgggctgagcttccttgttttacagaatatgacgatgcccaggaagtttaaatgatgtgcatcgggtcataacattattttttgtactatcatccatttaattgcagttgcaaacatcgtaaccaaagtacctctctcaagtcattctctagcacagtaattggtttcattttctttataatcttcatcactgtttgaaattttcttgttttgtcctgtaattgttgtcagtctcccctcattccatttctagcttttaatgttagaagggtcataacattattaaaggccaagagcaagactcaaatatgtaacttctgaatccaagtagggtgttcttttccctgcagggctgattaaacacgtaagtatcagatgaaggtttcaagccataaaggaaagggaaagtatcctctgcacaggagaagtcaaggaagttttcctggagggcgtgggcgagtcggcagtgctgggtgggtggcactgacctctacgcttgctctcagctgaccacactcctgcagacaaaggcagacatgattcttggctcttcacagatcccaccaccaggaggaatgccaaggctgggcccacagcgagaaaccgctatgccagccagtggaccctcaaccgaccccaccccaccatctcagcacacaccctcaccacagactggaggctgccaacacccagggctgcaggatcagtagacaaagagagcgacagttacagcgtcagcccctcgcaagacacaggtaggccctgacgctgcctcctccgtccctggggaccagcacggcccccgcaccttgagcttcatgggctccttggggaggggagagagggcttcctccctcttacttatgttcttttgaaggtcactttcaaattgttacgcggtttatctaacagttactaatacaactgcacagcctttactccacacagggcaaaacagagccaaactgcatctattctgcaggtgtcctgaatcttagacccaagcttatttctccatttagttcctaccccactgggagaaatagagacatttttaaattttcacccccgtgattgcagtaattgctgattacactctgagggcgtctgacccattaccatctccaagattaagacacagcacttgaagttacatgatgaggtcatagcaccctctatagggaacacaggctgatccgtttgacaattaaacaggggttggttataaggtaagtcatccagtctatgccatcaaccaccaagttttcacttcagagagaagacaggccctaagaatagcaccgggttgcccaccaccccctcttaaattttgaaaagaaattacatctgaatctaatagctgtaggaaattttaatactcatttttcttttgttcttgatgatatacttcaaaaacagtgttccagaggaggatcatcgccatgtgaatttatttttaaggctgtgatttctcttagaagagtctcagagttccacacagaggagaccctaaaactttttagtgcatttgaaacgcagacatctccctgaccaagatggcgtggcccagctcaaaggcatgtgggcaccagtttttgtcctgatggttttctagtccccataaagggtaatcacaacagaagacgcatcccaggggtcgggggccattctggcttgtggccaatttccgtgcaacatgacatctttatttctaaatatcatcacatcttccttcctgagctgaggccccagaagctgaactgcagctcaaatcattcatgccaattaaagagtctctagggcatagatccatttgcaggttggagcagagagggggctgctgcctggctcctactgttttcactaaaagcaggattttttttaaagggaaggcgttatttatttatggaaatgtcccaagctgggacatctgactacagcaatttggttgcaacaaagcttcccttaaccggatctgctgagacttgtgaagctggcctcagagtgcctaaggcaggagcctccgccaaggagccagaactcctaccaggtcccaccatgatctggaagaaaacagccccaagccaggaagggccatgccgttggttcagacttctgatggtgagtcgtccgtcttgtttttctctttcctggtgtagatcgagcaagaagcagcatggtctccacagaaagtgcctcctccacttacgaagaactggccagggcctacgaacacgccaagatggaagagcaactgaggcacgccaagttcaccatcacggagtgcttcatatcagacacgtcatcggagcagttgacggcagggacaaatgagtacacggacagtctgacctccagcaccccttccgaatcgggaatctgcaggttcactgcatctccccccaaacctcaggatggaggaagagtaatgaatatggcagttccaaaggcacatcggccaggtaggtgagcaaggccacctgggggccgtcgcttagggaagtgcaccttcctggtcctccctcatctgctgtgaaagcccttctcagtgttcagaccaaatgggtgctctgtttatggatggctgcataacaaaccatcccaaagttcactggattaaaactacagcagtcacttactttgtttatgaatctgaaatttgggcgggacctagtgagggtaccatgctgcagaggctctcctggggctggggatccacttccaaagtggctcaccgacctggctgtgttctccctgtgctggcctctccacaaggtgctttagcttcctcacagcatggtggctgggttctagcagcaaatggtccaagatacagtctgtggaaatagccagtttccttaggttgggcctggaaactgacacagctatcatttctgtcatattctattgggcaagcagtcacagagcccaagaaaccctgattccagagaaagaggcccccactgcttgatgagaagactgtcaaaaatgtgagggctgtattttaaaactgccacactgagggcttctgaaaggggagaggtcttactatatagtcagtgtttgggacttggcctcactgaattacacaaggtgatggtaactggctaacattaagtcagccagcagtttggtcttcaacttgaacacctgtgaatcgtccgggttgtgaaagctgcaaattttgaggtcagcaaggcatggcagataatagaatgcagaggctagagaacagggtcaaaggagcgaggcggacatgggccatttcagggttcactactgtctaaaagaaaagactctagcaaggccctgccaactgatcgcaagtggaaatggggtcttagtatggacttgtgttttaagagaagccggaaaacttggttttatatggaaattcacagctttttagtgttggcttggatatttgtaaaccattgtacagggcaaataaaacccatctttaggtggaatccaacctatggcagccaagtgtagttctcatctgaagaaccactttttctttttcaccctgaaatagttgcctgtagactttccttcacagactgatctatccaatcttattgaatccagttttgtttctcattttacccattttctacaccactgttctagttccatttcaaaaagtatcttcacttttgaattactacaattcccttgggttttatgggacaaggcctagctgaaatgagctttataaatgcataaaaatatataaaataagaatagtttatccagcaaataatcttccataccagctcaagattcatgccagcatccaataaagaatgatggcttcctttattttcattctgtctacctccttaggggaaaagacaagctgttatttgtgggtgtttttatttcaactattttttttttttcgtgttgttggcatttatttgcaaggcaaatggagaaaaatgcaggataaatgccatgactttctgcagctcttcagcctgaaggtgaggaggactggagagaagaccataagcctgtgggcatgttgtataggcgttctcagcttcagttcctgcatctgtaaaatgggaatggcgttggtgactgtgtactgggcttctgttagatgcacatagcattatacaggtgaaggggtcagcagaggaggcactcagccatgttagccattgtttctggcactgggttgctagaatccccactgtgactccagctgtactgctgacctcctcttccttcttgcttttatttttctccagtgaccactgaagtcctagcaggtacccacctcaattgtgtgtcacccagttaagtactttatgtttccacctgagatagcatgccgtcattttccctttgtgtgtgatttagggcacagaatgagcttctaggttaaaagactgtcctatttgtgcaggcctttacataattacagggttgaagcttgtttttgatggcacgctgctcatattgttggattgtttcttaaaaatttgacctttgctcatgatattgtgacctggacccattagagcaatggaagatcatagctaagttactattgtcttcatagactattcagagtaaaatgattttataaatataggtttgaataatctcttaaatcaatgcaagttcaaatgtccacaaactttgttttgtctaccctagatgactgcattattactgaacatctgatatgctttagaaaatatttcagcctttggaaacctttccgtcgctcctttataattcaactaaattcaacattgggcacaaaatacaaggttgcagtttactattctgctaactagagcttgtgatacaattagcagctcctagagctgtgcttttacatcacattctttccctatatgccctcttcacgctagatgatattcgtcatgtctgtttctgtttatagtcttccaaatctctcaatttcttcctcctcaactttagagcttcttttctgatggtcctttttttctctttccctttttattttttctgtcttcagtacaaatagttatgatccccagactttgaaattctctgcaaattgccatcaagttacatgaatttggccagactgtggcttcagaaaaataggaaatatgtcttagttatcttcatacttccttctcaaggtctagcagatacctgatagccaagtagttatcatgcaagaattatttttaaatgaattaatagtattgaatactcaatactacatacttaaaactctctctctatacataaatatatatatctcctgtgtgtgtttataatatacacatatatggccagactgtgtctggcacattagtagatgcttcataaaccttactgtatgaatgaatatatcatgcttgtgacaacaaaaccaactggttaaattggttaaaatatttcaattaatagaaattatagtcaaataaatacaaaaggacatttaaatctactccaactttcagtagctttaatcaaagtgacttattttccattctttttttttttgatttttatttcatctgcataatttaatcagtttttccttcacatattcaaaaacctacattggtatttttttctgacacgtttcccctgttagactttagtttttcttagttcatattctttttcttttcttttctttattattatactttaagtttcagggtacatgtgcatattgtgcaggttagttacatatgtatacatgtgccattctggtgcgctgcacccactaactggtcatctagcattaggtatatctcccagtgctatccctcccccctccccccaccccactacagtccccagagtgtgatgttccccttcctgtgtccatgtgatctcattgttcaattcccacctatgagtgagaatatgcggcgtttggttttttgttcttgcgatagtttactgagaatgatgatttccaatttcatccatgtccctacaaaggacatgaactcatcatttttaatggctgcatagtgttccatggtgtatatgtgccacattttcttaatccagtctatcattgttggacatttgggttggttccaagtctttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtttttggctgcataaatgtcttcttttgagaagtgtctgttcatgtccttcacccacttttcgatggggttgtttgtttttatcttgtaaatttgtttgagttcattgtagattctggatattagccctttgtcagatgagtaggttgcgaaaattttctcccattttgtaggttgcctgttcactctgatggtagtttcttttgctgtgcagaaactctttagtttaattagatcccatttgtcaattttggcttttgttgcctttgcttttggtgttttagacatgaagtccttacccatgcttatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggttggtcaaagatcagatagttgtagatatgcagcattatttctgagggctctgttctgttccattgttctatatctgtgttttggtaccagtaccatgctgttttggttactgtagccttgtagtatagtttgaagtcaggtagtgtgatgcctccagcttttttcttttggcttaggattgccttggcaatgcgggctcttttttggttccatatgaactttaaagtagtttcttccaattctgtgaagaaaggcattggtagcttgatggggatggcattgaatctgtaaattaccttgggcagtatggccattttcacgatattaattcttcctacccatgagcatagaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgacttttgtacattgattttgtatcctgagactttgctgaagttgcttatcagcttaaggagattttgggctgagacaatggggttttctagatatacaatcatgtcatctgcaaacagggacaatttgacttcctcttttcctacttgaataccctttatttccttctcctgcctaattgccctggccagaacttccaacactatgttgaataggagtggtgagagagggcatccctgtcttgtgccagttttcaagggaatgcttccagtttttgcccattcagtatgatattggctgtgggtttgtcatagatagctcttattattttgaaatacgtcccatcaatacctaatttattaagagtttttagcatgaagggttgttgaattttgtcaaaggccctttctgcatctatgcagataatcatgtggtttttgtctttggctctgtttatatgctggattacatttattgatatgtgtatattgaaccagccttgcatcccagggatgaagcccacttgatcatggtggataagctttttgatgtgctgctggattcggtctgccagtattttattgagggtttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttccttcttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggattggtggtgatgtcccctttatcattttttattgcatctatttgattcttctctctttttctctttattagtcttgctagcagtctatctattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctatacactgctttgaatgcgtcccagagattctggtatgttgtgtctttgttctcgttggtttcaaagaacatctttatttctagcttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaatacgtgtggtgtggtgctgaaaaaaatgtgtattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttgaagtctgttttatctgagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagactgtgtcttttaattggagcatttagtccatttacatgtaaagttaatattgttatgtgtgtatttgatcctgtcattatgatgttagctggttattttgctcgttagttgatgcagtttcttcctagcctcgacagtctttacaatttggcatgtttttgcagtgactggtactggttgttcctttccatgtttagtgcttcctttaggagctcttttagggccggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgctgagagatccactcttagtctgataggctttcctttgtgggtaacccaacctttctctctggctgcccttaacattttttccttcatttcaactttggtgaatctgacaattatgtgtcttggagttgctcttgtcaaggaatatctttgtggcattctctgtatttcctgaatctgaactttggcctgccttgctagattggggaagttctcctggataatatcctgcagagtgtttttcaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccatcactgataccctttcttccagttgatcgcatcggctcctgaggcttctgcattcttcacgtagttctcgagccttggttttcagctccatcagctcctttaagcacttctgtgtattagttattctagttatacattcttctaaatttttttcaaagttttcaacatctttgcctttggtttgaatgtcctcctgtagctcagagtaatttgatcgtctgaagccttcttctctcagcttgtcatagtcattctctgtccagctttgttccgttgctggtgaggaactgcattcctttggcagaggagaggcgctctgctttttagagtttccagtttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccctgtgaggtgtcagtctgcccctgctggggggtgcctcccagttaggctgctcgggggtccggggtcagggacccacttgaggaggcagtctgcccttctcagatgtccagctgcgtactgggaggaccactgctctcttcaaagctgtcagacagggacatttgagtctgcagaggttactgctgtctttttgtttgtctgtgccctgcccctagaggtggagcctacagaggcaggcaggcaggcctccttgagctgtggtgggctccacccagttcgagcttcctggctgctttgtttatctaagcaagcctgggcaatggggggcccccctcccccagcctcactgccgccttgcagtttgatctcagactgctgtgctagcaatcagcaagactcagtgggtgtgggaccctccaagccaggtgcgggatatagtctcgtggtgcgccgtgttttaagctcgtcagaaaagcgcagtattcgggtgggagtgacccgattttccaggtgccgtccgtcacccctttctttgactaggaaagggaactccctgacccctgtgcttcccgagtgatgcaatgcctcgccctgcttcggctcgcgcatggtgtgcacacccactgacctgcgcccactgtctggcactccctagtgagatgaacccggtacctcagatggaaatgccgaaatcacccgtcttctgcgtcgctcaggctgggagctgtagacgggagctgttcctattcggccatcttggctcctcccccccaggcacaatactttctaaaggcaccttgaagcctaaaagagcccttcttatactctgaggtatctcaccactgaaactggttacatacatctgtattgggaattaatggataagggtggaacaaatgaaatgcatttctgggggccagatattccaaagcagtttggggtagccttcttcctcctcctctgcaatgctttgttagttggaggctgtaaacatgccgatgctttcccaaatttgtgggaatgaatgtgaatcacagtttttggggcttcaatctcctctgcggacacataaaaaggaactttcatcaatttctaacaaggtttgagatctatgcctggatagagctggatattgatgcaaaagtaagaagcaaaagatgatttccttgagttccagcaatttcaataaaaaacacagagaccagacttgcaacaacactatagtgtcaaagagctggttcccaaaggggagcatagagtccacccataccagagacagacgagatctaacactttttgagtttaatattaatgttgcagcatggtaatgaaaactagtaaaagaatctctcttggtaaatgaatcttcactcccaaacggcaagcaggaaaaaccctaaataaataatgtgagattgatatcagaggcccatgtgcagggactcgattacaattcttggcttgtactcaggggccctcatgcattttttaagagctcatcaatattgtgatccttctgcttgctggtgaactttaaaaactacaccgaggtataaaagtagggctttgactttgttgaggcttatgattcttctcaaataaagtagatctgaataaaagacggattggaaaatcttccctggcctttaggcaagcacagaacttagcagtggttttggagcacccactatggaacgatccatgagatccaaagatggatacagttcccacacaacagccacaaggaaccacacattggggaccacctgaagcagaaccctagctgggggcttggccttgttctgccatgaagctgacagagctgtttctacaacaatgtgcatcttgaatcatcccacagaaggagctgagttaggctggaaatgagagaattccagacagagggaaggtatatttgtggagttgtaggaggccagaaagttgaaggctggagactaggggcaaggttggaggctggagaccaggggtcaaggcaaggaagacaaggctgacccctcagacgctagtaagtctctactgtgagagcagcaggaagccatggaagggggttaaacagaggaaggttgactcttactggaaatgatggcttgtctcccatttctggtttgggatacaggatgccttaggccctggtgccagcagagtgtacaggaggccacattggaagacgatggtctttgctgtcttcttacctttctgtatgctccctgggccttcgtgtggctttagcttctcacaaggcctcactgggctgtgtatgtgtgtgcgtgtttgtgtgtgtaggtggtgactgaccatcttctatgagctgggctttgtattatttcttgaccttctcaagatttgcctgtctcatgtcttcagaacccattgcctgcagtctttgatacacactattctgataaatgaatgagactgtgaggagtgttaatttaagatattaacccttttatgtgttagggtaatacccagtgtctttttactcaggagatattcaatcagtagggattcaatacacgagtgtcgtatatttgtgttttaaccgggtctgtctgagatgcagtgaacgttcagttagcctgggcagccttctttcttgtcatctgtagagctggaatctgggagcttccttctggtcactcagcagggacaaagaggcctctacccccacatcactgttctctaaggtacatgcctcccccatcactttccacctctcgaggaactggcacagcccaggatttcgcaatgattagaactgaaccccaataagctacccaagaaaaacagtgagccttttaaggggctcagaagtcagacaagagaatcagaacacagggaatacatgttctggaacaagaggacacaaacaccagcttagcaactgcagcaagtacagtgaaccagccagaccaccggacaaggtcagaggtacaggggatggcctcttgaacacagtggcaggaggatggttgcagggtagtggctgcagaagaccccatgtacatacatgctaagcttttatttcaggcaaagggcttagagttctaagcttgagaacccctcagaacaggtcctactgtcactttctgagtctgagggagagttactaagaagacactgaaattctataagagcccttaagaagctaaaattgcaaatactcctcagagagacctggatttccagcagaaatcaggattagcacatgccaatatttaggtcgacatcgagtgggcgtgaacagcagtatgtggaggctttgttggatggccccagggttcttttaacctaaaattctatgggagtgtttgaagggtcgtagttcagagggaactcttgatccctgttgtgaacgccaagctcattcctatctcctggcctttatctttgctcagctctctggaccaccagaaggatctttgcagggctccttccatcccatcatttacgtctcattgcctgagaggcctttccgggccattctttccaaaatactcccctcccacgttttatccccttcctggatttgcttctccacccagcactcaccacagtcgggaacgatactatttgtttgtttacttgatcagtggggatctctgtgggtcttgtctatcaatcactgcatcctcagttcccaaaacaggaccagtcatttagtgtccactcaacacacgcatggcaaaaaaagacagaggagcagggaggctgagagggagggagcaagccttcctctagaagggtggaacgcagagcagtgcagtgagaatgtgtgtgtgcctgtgtgtatccatgcatgggagcatgtgcttatgtatccacgtacatgtgcatgtgtgtcaacatatatgtgtccatgcatgtgtacttgtgtgtgaatgtgtatgtgtgcacgcatgtgtgtgcgcaagcacacgtgtaggcatcaaagagacttgcatttgaaaggagacccttagtataatatttatgataaacatttcaaaactgagttttagtgatgtgcagaacagaggaggaagatgcaagccccgaggcttggcaccccagctgcctgagccaagtcctcaggcagtgagggagatataggtaagtgaagctgggggtgggggttatttagctctgaagattggactgctggtgtcttgttttgatttcagagccaacatgacagatacccagacttcagagagggaaaacagcatggtcaaaatgacaactgagaatacggtggccagccttggtcagaatagtgctgacctgtgcagaggtaggctctttcttcaggtaagggctcctggcctctctgcatgccttggggcccgcctcctactctccaccctcacaccctcaggagagagtgatgcaagatgaatggatcctaaaattaaaatccagtaactctttcgaattactggcaatttagtgaattaacaagttggcaccaggcagtggccttttcccactaaaaaaaaaaaaaacaacctcaaatgcattccccaaggaaggggctgaaactcataaccttgtgtctggggcccagagggcatgagcacagagatccaaaggggctgatgctttccctaccactagtggggcaggctgtgttagggtgcatgtctgaaacttgaaactgaattaagtagcttcatgtaatggcttctcttgacggcacaggataaacatcataagaagaagaagcagtaatccaagaaggtttgcaactggctcaaaatgctacctgaaaccaagaattggaagccaccttgacccagaggaaaaaaaattgttaaactttgcagctatttctcaaaagaatagagaattttgttttctgtttgtagagatgggaatagtcatcccttatggaagaagacaataatttgctgcatttttaggacttgtaattgtacaggcaaattcaaaattcaggtagcattaaaattacagctagataatgctgcctgctttgtggatagctatcctcatttcaagggagagcacccctttatctgttgaagagatgtctttttgatttgctaagggcaagaatggaaaataagtgcgaataggaacagctccggtctgcagctcccagcgtgagcgacgcagaagacgggtgatctcggcatttccatctgaggtaccgggttcatctcactagggagtgccagacagtgggtgcgcacactgtgcgtgagccgaagcagagcgaggcattgcctcactcgggaagcacaaagggtcagggagttccctttcctagtcaaagaaaggggtgacggacggcacctggaaaatcgggtcactcccacccgaatactgtgcttttctgacgggcttaaaacatggcgcaccacgagattatatcccgcacctggcttggagggtcctacgcccatggagtctcgctgattgctagcagagcagtctgagatcaaactgcaaggtggcagccaggctgggggaggggggcccgccattgcccaggcttgcttaggtaaacaaagcagcctggaagctcgaactgggtggagcccaccacagctcaaggaggcctgcctgcctgcctctgtaggctgcacagacaaacaaaaagacagcagtaacctctgcagactcaaatgtccctgtctgacagctttgaagagagcagtggtcctcccagtacgcagctggacatctgagaagggcagactgcctcctcaagtgggtccctgaccccggacccccgagcagcctaactgggaggcaccccccagcaggggcagactgacacctcacagggcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaactggaaactctaaaaagcagagcgcctctcctctgccaaaggaatgcagttcctcaccagcaacggaacaaagctggacagagaatgactatgacaagctgagagaagaaggcttcagacgatcaaattactctgagctacaggaggacattcaaaccaaaggcaaagatgttgaaaactttgaaaaaaatttagaagaatgtataactagaataactaatacacagaagtgcttaaaggagctgatggagctgaaaaccaaggctcgagaactacgtgaagaatgcagaagcctcaggagccgatgcgatcaactggaagaaagggtatcagtgatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatggggagaatggaaccaagttgaaaaacactctgcaggatattatccaggagaacttccccaatctagcaaggcaggccaaagttcagattcaggaaatacagagaatgccacaaagatattccttgacaagagcaactccaagacacataattgtcagattcaccaaagttgaaatgaaggaaaaaatgttaagggcagccagagagaaaggtcgggttaccctcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcactaccaggcctgccctaaaagagctcctgaaggaagcactaaacatggaaaggaacaaccggtaccagccactgcaaaatcatgccaaaatgtagagaccatcaagactaggaagaaactgcatcaactaacgagcaaaataaccagctaacatcataatgacaggatcaaatacacacataacaatattaactttacatgtaaatggactaaatgctccaattaaaagacacagactggcaaattggataaagaaagagtcaagacccatcagtgtgctgtattcaggagacccatctcacgtgcagagacacacataggctcaaaataaaaggatggaggaagatctaccaagcaaatggaaaacaaaaaaaggcaggggttgcaatcctagtctcggataaaacagactttaagccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcatcaagtggacctaatagacatctacagaactctccaccccaaatcaacagaatacacatttttttcagcaccacaccacacctattccaaaattgaccacatacttggaagtaaagctctcctcagcaaatgtaaaagaacagaaattataacaaactgtctctcagaccacaggtcaatcaaactagatctcaggattaagaatctcactcaaaatcgctcaactacatggaaactgaacaacctgctcctgaatgactactgggtacataacgaaatgaaaccagaaataaagatgttctttgaaaccaacgagaacaaagacacaacataccagaatctctgggacgcattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagtagaaccgaagcaaatagagacacaaaaaacccttcaaaaaattaatgaatccaggagctggttttttgaaaggatcaacaaaatagatagactgctagcaagactaataaagagaaaaagagagaagaatcaaatagatgcaataaaaaatgataaaggggacatcaccaccaatcccacagaaatacaaactaccatcagagagtactacaaacacctctacgcaaataaactagaaaatctagaagaaatggataaattcctcgacacatacactctcccaagactaaaccaggaagaagttgaatctctgaatagaccaataacaggatctgaaattgtggcaacaatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagataattttagaccaatatccttgatgaacattgatgcaaaaatcctcaataaaatactggcagaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatgaagggtattcaattaggaaaagaggaagtcaaattgtccctgtttgcagatgacatgattgtgtatctagaaaaccccactgtctcagcccaaaatctccttaagctgataagcaacttcagcaaagtctcaggatacaaaatcaatgtacaaaagtcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaatggaagaacattctatgctcatgggtaggaagaatcaatatcgtgaaaatggccatactgcccaaggtaatttacagattcagtgccatccccatcaaggtaccaatgcctttcttcacagaattggaagaaactactttaaagttcatatggaaccaaaaaagagcccgcattgccaaggcaatcctaagccaaaagaaaaaagctggaggcatcacactacctgacttcaaactatactacaaggctacagtaaccaaaacagcatggtactggtaccaaaacacagatatagatcaatggaacagaacagagccctcagaaataatgccgcatatctacaactatctgatctttgaccaacctgagaaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaaaggcaacaaaagccaaaattgacaaatgggatctaattaaactaaagagtttctgcacagcaaaagaaactaccatcagagtgaacaggcaacctacaaaatgggagaaaattttcgcaacctactcatctgacaaagggctaatatccagaatctacaatgaactcaaacaaatttacaagataaaaacaaacaaccccatcgaaaagtgggtgaaggacatgaacagacacttctcaaaagaagacatttatgcagccaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggacctagaactagaaataccatttgacccagccatcccattactgggtatatacccaaaggaatataaatcatgctgctataaagacatatgcacacgtatgtttattgcggcattattcacaatagcaaagacttggaaccaacccaaatgtccaacaatgattggattaagaaaatgtggcacatatacaccatggaacactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaacatcacactctggggactgtagtggggtggggggaggggagagggatagcactgggagatatacctaatgctagatgactagttaatgggtgcagcacaccagcatggcacatgtatacatatgtaactaacctgcacaatatgcacatgtaccctaaaacttaaaataataaaagaaaaaaagaaaagaaaatactgctaaaatacatccaactcaatacttttggtaaatattacttgttgctaataaaaagtttagatataagaaaaaaaaaaagaatgtattgtgcctcattcatttgtctaaaggcaagagcaccaaggctcaaaagggtcacaaaactacctggaggcagaagcagaggcagagacaggatttcaacaccaagccctgcactctgtaactactgctctttccactggaatcagctcctgcctcagcgggtgccaatggagaaagacctgggggttttgccttctgattacagttccattggaccatctcttattttcttccatgaagaactgaggtcgtaactccttgtggactagtattctgaggctgaggggtacaactgcttatcctggttgaattcaatgctttataagtagaattaaagtgaaataaggaacacttggccttatgaattctgatcatctaaaacagagtttctcaacagcagcaccgttagtatttgaagccagatcattcttcgtggcaggggctattctgagcattggatgatgttgagcagcacccctggcctctgaccaataggtatcaatagtgtcaccctcccctgtgttatgacaatcaaaatgtctccagactttgctacatgtcccctggggacaaagccaccctcagtggagagcctctgatctagtgttcagatattttcccctagtgtggtgcctgggagatagcaagaaccatagcaagaaccattgtttgatgatggattaatggaatgcacatccattttctgaattgcttcattcttgttatttcagtattgattttgccatccttcttccaagaactgaaatacattcaaaccttgcgtgtgtctgaatagattgagaaaattcaggaagttttgctttcctaggtttcagctaaaaggaggcaggtttagttcagcagttttcccacagtcaggccaaccatggttctaatgcaccgttagtggagggggacaagctctgagtgtgaatctgctgatggatgtggggcctgcagaaggaatctgtacatttcaggaccagaggcaaggaggagcttgtgatactagtatgcaaagtggttagagaaagagagagaaatcaatgctgacctatttaatcagaacttttggagacattaatggcactgaaggtccccagagggcagcaacagaaggatgagaaatgaagcatgatgtcaaataagaaagcaaaatgctgcaataatgggtaaagcgtctcatcctcaaggcggaagtcaaagcagctgcctgggttccctccagaaaggcagtgatgggtgcagcctgtgatctgcactgggttttggtgaggctgatgagaaaagaatgagaaatgggtgccccagtgatggatgggccagtggtccttgtatggtgcacacatctttaaagctccacaagggccgttcaaagtgggtggtacacatttattctcatagtactcacctttctggtgccctcttcctccactgctccttaccactgtcccagatggttaccatgttccccttttcccttctctatttgtgactctgtctctaatttttatctgtctaccgacctgcgtagctatgtttcttttctttttttttttttttttttttgagacggagtctcgctctatcgcccaggttagagtgctacgtttctttctttctgcctccctgtgtgtgtttccatctctctgatccctctctctctctctgtgtgtctcttcccctctctctcatccatcctccctcacacccccccagccttattcatctcagcctcccctgaccctggtatgttcctgcatctcagtccctgaactcagtttcccagagcccttctctgtgcttggccatctccaccttctccatccctcaccctcacttagggtctctgacaggaagggcattggcctcagggcagagcacagtgggttcatggtgtgcaaatccaccattacagcccaaagaagtcagcagggggaccctgtcccaaaggcccaggcaggactctgtgagcctttgtattcatgctgggcctgggctggagacactaactgggtttagctcactgggaaggaaccggcagtgcgggcaggtaggtgagcagggcagaaggagggcatggaagtgagttcaagctcagttcctcctgccgtcagaccatgagctggatcctcctaccagcgctagtcctttccttctccatgcctcaacttcccctttcagtatgctgctcttccagttagattttccctcccatatctctctcctctctctctctctctcacacacacacacacaccacacttttcttgatgtgtatgccctgcttgctgtcttattgcactcagctacctctttgtccctcccctgcttcatgtttttaccccttttctatgcctttgatttcgtggatagaagttttagcacaagggaaacaaaacaaggaaaagaaggaaggaaggaaggaagttagttttcatgttgcctgagactgggtaatttataaagaagagatttaatggactcacagttccatgtggctggggaagcctcacaatcatggcggaaggtgacaggcacatcttatatggtggcaggcaagagaaaaatgagagccaagtgaatggggcaaccccttataaagccatcagaccttgtgagactcatccactaccatgagaacagtatgggggaaaccactgccatgattcaattacttcccactgggtccctcctacaacacatgggaattatgggagctacaattcaagaagagatttgggtggggacacagccaaactatattagaaggaaaataaaggaaagaatggagggaatgagagaaagagataaagagacaggaggaagggaaagaaggagggagaaggggaaggggggaaatgtggagaaaggttgagggaagcaaagcagaggaagtgaagtgacaccatagagtatggaaatcattgccaaaaatataagtgaattttgtcatagctggttttactgaaacaagtactaagactgggcatttgcctttgccagtgtttatggcaatgatagatttacacacagggatgccgagggcatttgcacccagtggaggtgagtacccatgacatggtgacccaatatggtgaccctggagttcaaagcacaaaggatccttggacttcttctggatccctgctacttttcactgcatgggagaactggagagggtcctgaatggtaagctgtggggcaggtgagctggggagtaccagacacacccaagaaggccctgctccctgtggaaacagattccttaatccagggaaagctttcacatgcattatctaagttactcttcaccacagccctctatgctagattctgctattactcccattttatggataaggaaactgagcccagatctagacctgtcagataaatgcaggcaatgttatcctggcctctattcctcatcaccacaattaaagccaagggctggtttctcccatgtgacacaggcagatggcaggcagggcactggggaatgctgtgccaatgtccccatggtcaccacagtctcacacatcatgtgtctctttctggatcaataactgcatgagttgtcttgctatgtgtaggcatcttaagcatataggaggacaattagagaatccaggtcctcagaggctttgttgatgagcacatgggctggggttttaaagaacataagtgcctgtaataacagagcttaccgctgactactctggtgctctcttctctgtaagtgcattaattattgagagaactcatttgcagcacgcacacagttgaaagggctactttggacgctaatcagaaaatacacattgttgaagggagctaattagagaatcacacaactttgtagagctttgcctgaaaaactggatcaatcagagatattggatattcagagatacttgtcagacctgcaataaacaaatacatgtaggcattgcatgtaaagatgtaacactgagctgtttccattaggaaggatttttatttctcatctgtccatttcagtgactggagccctcttgataactacatctgaagtgggagcccctgcaggcaggatgcagatattatgagtcctatcttttgatttcaaacacgtttcttccttccaatctaagacctgcgcattctgcagtccagccgggaccacaatgctattactttgtggaggtttaataagccctgtgcattcaatggggagtcactaaaatagagatttatccccaaatctgttgcaacacattacaaatatgtcaagcgttcgtgattgagtcgggtctcagaaagagcatgaggcattcttgacctatatatttaaagaaccctggaggtaaatgtctgtcccatttcctcaaatatacaaacaacatgataaaaataatattgaataaaaataatttaaaatttaaaataaataaataataaaattaacaatttgtttatcagattcttaggaataaagacataatcactttcaggagattgaatgtataaaactacaaatcgcaagactggtcaattaaggtgtattgattcacatacaaaaggatgttcacattacaaaagaattattcaattttttcttaatgacagctctgttaatgctttcatcactttttttgcaaataatccctggttagagaagactgaagaataactaccataaacgaacattagtaattttcaatgccatcaagtttcataaagttttaaaaactcaaattctttcaggaacaaagctattctatatggcaagagattcctgaaccctccacattagtgtctataatgggtaggcctcatgccattatatttttctaagccaaagttcagatgcatcaagttaccaaaaccctttttacaagaatgccaaattatgtaattccttcctataagaatgttatgggccaggtgcggtggctcacgcctgtaatcccaacactttgggaggctgaggcgggtggatcacccgaggtcaggaatatgagaccagcctgaccaacatggagaaaccctgtctctactaaaaatacaaaaattagccaggcgtggtggtgcatgcctgtaatcccagctactcaggaggctgaggggggagaatcgcttgaaccgggaggtggaggttgtggcgaaccgagttgcactccagcctgggcgacaagagcaaaactccatctcaaaaaaaaaaaaaatgttatggcccatttattgtctaggtatttattactgagcttcccttggatccagttgacagtaggaagccaacgttgaattagaatgcctttaatttcagtgagcccagtccagtgtcgctggggtcatttagtgaattacatgctgccattcccagtgaaatcatataactactcatcatcacttagtagaataaagatatcctgaaaaagctaaatggagttttgaatcataaatcccaagtggtgcaacaatgtaataacacaatgacaaagaaatcatttgctgcatttcccaaaaataaggtcattgctcctgttgttcgcggaaaaaaattttcaagacgggtaataacattttgaaaatttgtatgctcatttaaattgtataaaatgcatttttagggcttgatttggccatatttatttttagttctcttatactttttttttttttttttgagatggagtttcatccttgttgcccaggatagagtgcaatcgtgcagcaacctccaatgcgcaggttcaaaagattctcctgcctcagcctcctgagtagctgggattacaggcgtgtaccaccacgtccagctgatttttctattttcagtagagacggggtttccccattttggcctggctggtctcgaacacctgacctcaggtgatccattgcctaggcctcccaaagtgggcggggattacaggccagttctcttatactcttgaatagtcctttccttctgttatgctggttgttctttttctgtgggtaaacttgaaggtgtttcctaaggttcaggctttaaacactgtctaaacacatatcactttcattgccccgctagcagagcagctggctaatggcagccctcacttggctcaggtggtctcagatcccctcagcctgcaccttcggggcctatgggtccaaaggggctggatgaggaaggctcaattaattattgttagcatacagtaacataaggaaagcaggggatattttgaagcaaaagaaacaagaatgttcagttactttagactcagaaaacgagcagtgagtcatcctagagctacgtttctatgataaaaatacctactagatatcttgtcttgaatgtccccagctgcatcaaactcagcaggtctgaaactaaacccttcatcttttgtcatcaaagtacgatctttcccctatacaccctttcacagttagtgatttcactgtccacacagtttcctgagcttagagcctgggaaggagtcacccctaaccccttctcctctgtcaccactcccacttgtcattgactctgaagccaccttccttggacccccttcatatctcacaatttaattccctctctcacatcccacagctgctcctgagctcagaccatcatcatatctctctccctgcacatcctttaccctgggccctcgctccaggaccacacaccaccagcccattctctagacagagttttgcacctggtatgtcacgagttacaggtgtgccaagatggtgagtccttcagacctcaaggtggccagaaacagctccctgggttcatcccagtgtactgcacaaataccccttgtctgcctgttcctcaaaaagtgggaagcactgggctggataaggcacactgtctgtaccaaaacagcagaaactcagacccagcgtcagtccagctcaagtcaggcagtgttggttgcaaagtggacctggtggctgggccctaattgtgctcatgctttgcaaggaggtgatgggatatattaaagccttgaaacagggccctgaagatgggaatgagaaggagtcaaggccaggtggctcatgtctgtaatcccagtgctttgagaagctgaggcaggagcatcacttgagttcaagagtttgagaccagcctgggaaaccaagcaagaccctgtgtctccagaatattttaagaataataattagccaggcatggtggtatgtaactgtagccctagctactctggaggctgaggtggaaggtttgcttgagcccaggagtttgaggctacagtgagccatgaatgcaccattgcactctagcctgggcaacagagcaagactctatctcttcttgtttaaaaaagaaaaaaaaaaaaaagagtcaagagatattttgccggtagaattaacctggagagaaaggtgtcagtgaaacctctgaggtttcaaggatggaaggatggtgataatgttacacaagatggagcacacaggagagaagcagtatttgggattgggaggggatggggttggccttcattaactgaattggtagactgtggccttcagaattccagatggacactcgtgtggaaatgcctagcaaagcacctaaaattcacatctagggctcaggagaaagagcaaaatggaaaagatagatgggaatgttatttataaagcaatgaggaaagcagccaagccttccgagagaggcctgagagcaggccactgaacactccgtatttagaggaaagacagagaaaaggatccagtcaaggaaagtgagaaagggtggccagaaatgtaggcagagatctggaagaccacagtgccctggcagctgaaagggccaacaacaaaaatatcaacggcatcaaatgctatagtaatgcaggtaggaagaggacgaagaggaaaccagagaatttggcaatgagaggtcagggtgacctttcagtagctgatggtgaaagaagctgtgtcagttcaggtttttgagaagcgcctagcaagacagattagacacacaaggaatttattggggaaattcttgtgaagaaggaagcaaaaggaagcaggaggtggcaaggagagtctggagaccataacagaggtccgacacctgtgagaggagaaggcgaaggagggattggttggaggcacgtcaggctgcggtgcacttctgagaaggctgcagtgaggctgatggggtatccctgagcaaaggatgcctgttagggagatcctgcatcgggcggggacggccatgagaaaagccctgtcacgcttgtcattggcttgcagcatcccagagaacacatgcctcccttcctgcagcagatgctcttggtttttttgttttggtttgggttttttgtttgttttgttttgttttgttttgttttgtttgagtcttgctctgtcacccaggctggagtgcagtggcataatctcagctcactgcaacctcctcctcccgggttcaagcgattctcctgcctcagtgtccccagtactgggactacaggcgcccaccatcatgcttggctagtttttgtatttttagtagagagggggttttgccatgttggcctggctggtcttgaactcctgacctcaggtgatccttccgcctcggcctcccgaagttctaggattacaggcatgaggcacaccgtgcccagccagcagatgctcttgaaggagacctgaggttatgtttgcgtggcaccacagaagccagagtgaccataagcaggaagtagaaacactagaattctggtctaagctgctgtcatctctatacacagcatggctgaaacagaagagccacgcagaagttagcaggtaggcagggcctggtaagaaggccataagctgtggcgctttcacccaaagccatcatgaagacccataactaagtggctggccaaggtcacaaggtttcatagaattgccaggacgagagccagctgtccatcttcgcttggcgtccctggctctctcctcaaaccctgtgctctccctgtacttccaatcacatgcggggtttggtctatcaccgttcgtacccagtggacactgatgcctttgatgtatgtttttctttcaacgatggtgtgttgaaggattctgttacctccattcctccatttctgtacaagtaagttaatacaagtaagtaagtactgtaggaaaatgagctcctcccgcgcccagggaggaggtaggaggacgattccacctgtctttgtggtgagcgctgaaggaggatcttgagaaaggcacctgtgtgcagcggcattctcatctctaaagcccgcatggcttcccgtgtgcacacaggacattctgcccatgtttaccaaatgaagacaccaactaactaccctgtctttccttctaggtgacctcatacatttgcctccataccttagaatggactttttgttaaaccgaggtggtccaggcaccagcagggacctgagcttaggacaagcatgcttggaacctcagaaaagccggaccctgaagcgccccacggtcctggagcccatcccgatggaagccgcctcctccgcctcctccacgagagaaggacagtcgtggcagccgggggccgtggccacattacctcagcgggagggagcagagctgggacaggcagctaaaatgagcagctcccaagaatcactgctcgactcccggggccatttgaaaggaaacaatccttacgcaaaatcttacaccctggtataacagacagcatgactggacagcggttgtaaatacaattcaaacaattcaatcaaagctaccttttttttacggaattccaatatttataattaaagaaaattgccaaaatatattaaaaaaaaaaaagagaaaatactgaaaccacagacagtgcaaagactctcctgctttttttctgtctgagtgtgagctccatccgcctgggcatctgattttttgggaaagaagtccagttttatgatcttcacaggctattgcatttttactgattttctacaaaagtgcatgggggggattaattaaaccttctgactggaagttctatcacacaagaggcaagaaagaaaacagggtgggtgggaaatcagcctatttgtgaatttaaaaggaacaccgatttgcgggcaggggaaaacttcagtcacgtttgcacacctttctttcccattagaaaccgggttctcaatttggtcttcttttgttgttaattaggatgagtgccgtcagtgaaggggtggggggaatcaatttggttttctctcttgtttcttttttaatttaatgagacactctttgcattttgtctaagcgaaataaaaaagaaaaggttgtctgcctttatttccatgtctgcttctctcgtcttctgccagtggcctggtcctccttcccattgacacttctgtttggaaacaccaggcctgaacccagagcccaattcaataaaccagagtcgatactaacaccctgaactcctcaggaatctccaggaagcacaaagaaggtgcagctcctgctctcaagctggagaggacaaaatgcaggctggtctccaccgcaaccagaggccagcccaagtattcgaagcccgtcgcaaagctctgccccttgcctgcccatggccagagttcaactgactgtggcctatgggccaaatccagcctcctgctgttttttaaataaagttttattgaaacaaggccacatgcactatttgctattgtctatggctgctttcatggcacaatggtagagctgaatagttgcagcagagatggtatagcccatgaagcctaaaatatttattacctggcccattacaggaaacatttgccagacccgtgctctggagtctgaaatgtagccccagcttgcgtgacaaggggcaagatcgtgcatcttaccctccatgacttttcctatctccactatgcctggtatgcaaatttgtgatagaccatcttaataaacattgcctgaatcctctgtaaccagaggaaagtgatgttcctctaaaatctaagtttttactttcctttccctcactttatctcccatgtggctcatcctaagagagaatttactcataaatagtcggaactgcattctttatcccacaaccctcacagggtttgctttatgaaagaggatgtaatcctcccctggctgcaacactccattccaggctcacttccataaaatggaaagataaacaggtctttgtgtcagagatttggcattaaccagaaaacatgatcaaatatccacagctgctcagtctcccaggctgaagattctctacaggcttccattaaggccaccaacatagactggtgccagttattaccatcttgggaacatattcagaaatgtctttccttccctccctccctccttctttcccatcctttcttccttctatttattttccaggcaggcccatttgtctgcttagattcagtgacacagaatgggtccaggaccatgtcaagaccacctgctgatgctagtgttagatgactccaggaatgtgaggtgtgcatccatggtttcagaatgtaatccgtgttgacgtgtactgtttgcatactctcagactgttttttttttatgcaaaagaaatgttactttctgggggaaaaaattaaaagtctatctttcatcaacctaaaacttctatatcccccaaacatagaagtttacctttttaacatttttctctcaacctgtacaaaaataaaaaaattctacatta

SEQ ID NO: 201 - DNA, 92 bp, Homo sapiens
attggaaggtcagccaatcaggcgcggagctgctcccggtagctgccacctccgaggcgcgcgccacgccggggttccctcgcggctttgga

SEQ ID NO: 202 - DNA, 87 bp, Homo sapiens
tccgtgtgctccaccctttgaattcagaacgacatagtggatactccgtggggctgctggaatcttccattcccactgccttatctt

SEQ ID NO: 203 - DNA, 99 bp, Homo sapiens
aaggtgcgaactcctctttgtctctgcgtgcccggcgcgcccccctcccggtgggtgataaacccactctggcgccggccatgcgctgggtgattaatt

SEQ ID NO: 204 - DNA, 71 bp, Homo sapiens
tgttcactggaggactcatcagaggtcccattctcctttttgtgtctttcatcaaacaccctcatggactg

SEQ ID NO: 205 - DNA, 22 bp, Homo sapiens
attggaaggtcagccaatcagg

SEQ ID NO: 206 - DNA, 19 bp, Homo sapiens
tccaaagccgcgagggaac

SEQ ID NO: 207 - DNA, 20 bp, Homo sapiens
cgcctcggaggtggcagctc

SEQ ID NO: 208 - DNA, 20 bp, Homo sapiens
tccgtgtgctccaccctttg

SEQ ID NO: 209 - DNA, 24 bp, Homo sapiens
aagataaggcagtgggaatggaag

SEQ ID NO: 210 - DNA, 22 bp, Homo sapiens
ccagcagccccacggagtatcc

SEQ ID NO: 211 - DNA, 22 bp, Homo sapiens
aaggtgcgaactcctctttgtc

SEQ ID NO: 212 - DNA, 22 bp, Homo sapiens
aattaatcacccagcgcatggc

SEQ ID NO: 213 - DNA, 23 bp, Homo sapiens
cccctcccggtgggtgataaacc

SEQ ID NO: 214 - DNA, 20 bp, Homo sapiens
tgttcactggaggactcatc

SEQ ID NO: 215 - DNA, 19 bp, Homo sapiens
cagtccatgagggtgtttg

SEQ ID NO: 216 - DNA, 28 bp, Homo sapiens
aggtcccattctcctttttgtgtctttc

SEQ ID NO: 217 - DNA, 182411 bp, Homo sapiens
  PCDHGA1
tctggatgactctccagtcagaattctcctgaaaattgggttaatttcagctcagaaaagcagaaacgatacccttggtactggactggaagaaaactacgaagtgagagagccatgaagattcagaaaaagctgactggctgcagcaggctgatgcttctgtgtctttctctggagctgctgttggaagctggggctgggaatattcactactcagtgccggaagagacagacaaaggttccttcgtaggcaacatcgccaaggacctagggctgcaaccccaggagctggcagatggcggagtccgcatcgtctccagaggtaggatgccgcttttcgctctgaatcctagaagtggcagcttgatcaccgcgcgcaggatagaccgggaggagctctgcgctcagagcatgccgtgtctcgtgagttttaatatccttgttgaggataaaatgaagctttttcctgttgaagtagaaataattgatattaatgacaacactccccaattccagttagaggaactggagtttaaaatgaatgaaataacgactccaggtaccagagtctcattgccttttgggcaagaccttgatgtgggtatgaactcactccagagctaccaactcagctctaaccctcatttctccctggatgtgcaacagggagccgatgggcctcaacatccagagatggtgctgcagagtcccttagacagagaagaagaagctgtccaccacctcatcctcacagcttctgatgggggtgaaccagtccgttcagggaccctcagaatttacattcaggtggtggatgcaaatgacaatcctccagcatttactcaggcacaataccatataaatgtccccgaaaacgtgccgctgggtactcagctgctcatggtaaatgccactgaccctgatgagggagccaatggggaagtaacgtactcctttcacaatgtagaccacagagtggcccaaatatttcgtttagattcttacacaggagaaatatcaaataaagaaccactagatttcgaagaatacaaaatgtattcaatggaagttcaagcccaggatggtgcggggctcatggctaaagttaaggtactgatcaaagttttggatgtaaatgataatgccccagaagtgaccatcacctctgtcaccactgcagttccagaaaactttcctcctgggaccataattgctcttatcagtgtgcatgaccaggactcaggagacaatggctacaccacatgtttcattcctggaaatttaccctttaaattggaaaagttagttgataattattaccgtttagtgactgaaagaacactggacagagaacttatctctgggtacaacatcacaataacagcaatagaccaaggaactccagctctatctactgaaactcacatttcactactagtgacagatatcaatgacaactccccagtcttccatcaggactcctactctgcctacattcccgaaaacaaccccagaggagcctccatcttctctgtgagggcccacgacttggacagcaatgagaatgcacaaatcacttactccctaatagaggacactatccagggggcacccctatctgcctacctctccatcaactccgacactggggtcctgtatgcgctgcgatccttcgactatgagcagttccgggacatgcaactgaaagtgatggcgcgggacagtggggatccgcccctcagcagcaacgtgtctctcagcctattcctgctggaccagaacgacaacgcgcccgagatcctgtaccccgccctccccacagatggttctaccggcgtggagctggcgcccctctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagtctcgtggtggccgtccaggaccacggccagcccccgctctccgccactgtcacgctcaccgtggccgtggccgacaggatctccgacatcctggccgacctgggcagcctcgagccctccgccaaacccaacgattcggacctcactctgtacctggtggtggcggcggccgcggtctcctgcgtcttcctggccttcgtcatcgtgctgctggcgcacaggctgcggcgctggcacaagtcacgtctgctacaggcttcgggaggcggcttagcgagcatgcccggttcgcactttgtgggcgtggacggggttcgggctttcctgcagacctattcccacgaggtctccctcactgcggactcgcggaagagccacctgattttcccccagcccaactatgcggacacactcatcagccaggagagctgtgagaaaaagggttttctatcagcaccccagtctttacttgaagacaaaaaggaaccattttctcaggtaaacttttgtgatgaatgtatcagctatctagagaaaaataattcttgatttaacttactagcgttcgctctttgctacagatagttcttctaacccatgtatctttgtagctttttattacaagtcctgcaaaatcacgattgagtctacacgttcatatgcaggtatatttataattgttcttgcactgaaaaggagactgtgatcataatgtaggtggttgggttgaaggtatgtgtgagatgccatctctgtttggaaagagcactgcattagaaacggcgatctagcttctaacattttcttacttgcctctgggctaaaaggtttgattagaaaaggctcaccaatatttaaatgactaacactattttcaaattttctttttataagtacctgctaatctacccctgaatttaatgtagatgtcatctgtcaggacactgtgatagtttatttggggacatttgaagaggtgaagattgtctaaagtagtatttttagttgtgttcatataagattatagagatctatataaactgcaattttaaattattgttgaatattttagccttttattctatctttattatcagatttttttggttttgagatggggtcatgctagagtgcagtggcatgatcatggctcactgcagccactacctcctgggctcaagcgatcctcccacctcagcctctcaaagtgctgatattacaggtgtgagctgtggtgcctgtactgaagaatacgtctatttaagtaatgtatgaagtaacaaaatgaacaacacaaaatttatcatgcaacttgagaaatatctttgaagcctcctgacttatacattatacctgtaatgaaatcagctaacaaaaatcaagtatatatcctattttaatgtgtgttaacttttcagaagaaaaaaaaagtatggtcggggagtaagtccatgctttgatgtatttactctgctccaataaaatacagagatacataaaatataagaggaaagcaaaagcaaagtggtgagctagtctaaagccatgtgagttatagtcttggacttaaaagcagaaattgaaggttaggaaactgcctccagcaatgtaatagggacagaagtgcttcagactagataaatatctggaccaggcttactgcctgaatccaaaataagcaatgaggcccttcagctggttaaaaaggaaaagaaagatgcattaacatgctgcctagctgggcgcagtggctcacgtctgtatttccaacaatttgagaggctgaggcggaaagatccttggagccctggagttcaagaccagccggacagggcggcctgcgactgtagtcccagctacgcggggcggggaggggcggggcggggcggggcaggagctgacgtgggaggatcccttgagcccaggaagtcaaggcttcagcgaaccgtgatcgcgccactgccctccagcctgggcgacagagccacaccctgttaaataaataaatataataataaaagctgtttcccaattccggtggttataactttcttcgtaagctgtgtagaccaagagagagagacagacacggatgctggatagagacagcgaacaccaagtatctcatatgtgagctgtggtatccagaatatcactgctgtgcatcattaaagcgtcattaagagacctagttatggcctgggacctgaggtcagatagaaactatttcaaaaccattacaaatgagcactgaacccaggagggaaggagagagggatatagtgtagaagagaaaaaaacaaactaaaactaaaaacaaacagagctcttccactaaaaataaatatacaaaccaaaatttcaaaacacacttgtctcgtagaatttattgttactagtgagaaactttctgtcaacacactgttattttttaaggtaatctctgttttctctctggtaactattgaagactttctctcattcttgctgtgtgtctgttgcatttttatttttattttttgcttggtaccaagagtatactctcaattgataactaagttatctcacttctggactttctcagctcttataatcataattttttttctgtgtatatacaagtgagctacatttacctattaaaggacaaatattacaaaactggttgatttttaaaatccatattctaataatacacgtgcttaaaataaaaatacactgaaacagtgaaactaaatatatatgtacacacacaaaaaagaaagtcatgttaatgtaacaacaaagtcatatttaaggtaacaaacacaaattgtgattttaaaaaatgaactgattatagttgtaaaaagagcagatgatcaaaaggatataaaaatataagcttctattactgaaaaatatagcttagaaaataccggaatatttaaacataattccataagaaataatagaccccacaggaagaaagttagttaacataaagaagatttgaacaacataatttagaagcttgatctattaggattctaatagatccgttctgcacacaacaaatatggaatagtcatccttgaacaagcagacaatctacaagtttattacctagtcattacaaaaaagggttcagcaaattgcaaagtaccaataatatacttgccttacaacacatacttaatcacaaagcaaacatttaaaaatagaaaagggaaaaagtttggatatttacatctacacccttaaataactcttggatttcaaaaatcacaatgacaatgaaaactactcagaaaaaaaggacttaaatattctttattaaaaattgtgagatgcaactaaaactaattaggagtaagtttatagacaaatgcaataatttttttaaaagcaaacaaaattatttaaaatacatgaatttagcttgccattcaagaagtaagataaaaaacatacaatgagtatatactaaaataaaatgatggaaaaaataacaaagagttacatttttgaaatgcaaccatggaagagttctgaggatgaaataatggaagcagacaataaatgtaataaaaccagtggggagaaaatgaaaattctgtcaagtctaacgttaggactcatgtaagagagccaggcacaatggcacacctataatcccaggtactgagtaggctgaggcagtaggattgcttgagcccaggagtttgaatccagccggggcagtataacaagacccaatctctataaaacaaaaaaacacaaacacaaacacaaaaataaaaataaaaaacaaaagcaaaatataccatagtagctctacaagaaaacatggtgagttggtatcaattatttccaatatatttttcttcagtcttgtaagaggaatggatgaaagtaaaaatgagaaaatttcaataaggaaggagccaaaaggcaaacagattaaagtgtcaccagaaatgggcaattccacttatgccacatacaaaaattaattcaaaatggatcaaagaagcaatattcagaagcaataaaacccttttagttattatgtttaagaactaaaactatacaactcttagaagaaaacaggaggaaaccttcataacattgatttttggcaatgatttcttggatatgacaccaaaagcacaagcaacaaaagaaaaaaattgtatactggactttatcacagttaaaaactatatgcagcaaagaacaatatcaatagagtgaaaaggcagcccacagaaagagagaaaatgtttccaaatcatgtatctgagaatggatatccagaataaagaactcgaactcaacaacaaagaatcccaaacaattggatgttaaaatgagcaaaggacttgaatagacatttctccaaagatgatatacaaatggccaaaaccatatgaaacaatgttcaacatcactagtcattagggaaatgcaaatcaaaaccataatgagatactactccacattcattagaattgctgtcataaaagaaaagaaaagaaatgttaacaagaatatggagaaattggaattcttgtgcattgctggtgaatataaaatgacacaactgctgtggaaaatggtatggtgactcctcaaaaatttaaacatagaattaccatataatccagcaattccactctggttattacccaaaagaagtgaaaatagggacttcaacagatatttgtacacctatgtttatggcatcattagtcacaatagttgaaaagtggaagtaacccaagtgtccattgacagatgaatgggtaaataaaaagtggttcacacatacaatgggctgttatttagccttaaaaaggaagggaattctgttacatgctacaatatggacgaacttcaaagacatgatatcaagtgaaataaacctgttataaaatgacaaatactgtatgattcctcatatatgaagttcctagattagtcaaattcatagagaaaaaaggtagaatggtagttgccagggactgggtgaaaggcaatggggagttgctatttaataagtacagagtttcagttggggaggatgaaaaagttctggaagtggatggtggtaatggtcacaccagaatgtaatttgaatgtacttaatgtcacagaattgtatgcttgactatggtcaaaatggtaaagatgaaacaagagtaagaagacatccactgcattgtattttacacccttggaaaatgaatatcagaaaaagaacttgacaacctcaaacaattttgagtgactgattcctagtgtggtgaaaaaccccttccggctctagctttatcaaatagacctgctttctgtttctgtaatgttccatgctgtctcttaccttcaagcatttgttcagaggttctagaacacttcttcagcctttttcttgattcaatcctactttttatgattcagcttcaatcatgccctcaaaaagacttttctgaccccaaatctagactggatacccctcctaggtattcctccatcacccagtgtttcctacctcatatcacagcagttaccatactctattatactctctttactttcttatgtcctcctccaaccttcacgcttgagaccagggcctgtgtttatcatgttcaccatttctagctccagctgcaatcatgcaaagtgggaggcacatgtacccaattaagtgtctgatgattcaataatttaaaggcagattttgaaggtaaatgcaaagccatcaaccataaacgttcaaaatatataaccttagaagaaaacgtagctaacgtttcttaattgatcttactgcttctgattatacaataagagatggaagatgtttggagcaagggcagtggtggcattgattaatgccttgagcagtcaataatactttcctagcaactattatcaagatcatgttcatttataccattcttattaatcctgataaaaagattcctgttttgaaagatctaattctagggtatcttagagctgtaagattctttaaagcgccttgaaagtcaacaaaggcaaacaaacaagaagtaacttaggttttcctgagcaggtgcagaaattatttaggcctctgagcgtcgctgttgaccacctaaggagtaaaaggcagcgagacatccaatccagcaatacggctcccacagcacaagggggtggaggtttggccctaaagcttcaggacaccaaagaaattcagtcgaacagcccaccagttctctccatagggacctgggtcccgtgaatgctggttatctcacaccctgaggaataaagattggaatccgcactggatgctggaagttgactcggagaaaattgcgacaggagggaaatggcggctctgcaaaagttgccacactgcagaaagctggtcctgctgtgcttccttttggcgaccctgtgggaggccagggccgggcagattcgctattctgtgcgggaagagatcgacagaggctccttcgtaggcaacatcgccaaggacttgggtttggagcccctggcactggcagagcagggagtccgcatcgtctccagaggtaggtcccagctctttgctctgaacccgcgaagcggcagcttggtcactgcgaacaggatagaccgggaggagctctgcgctcagagcgcaccctgtctgttgaattttaacattctgctggaggataaattgactatttattcagtagaggtggaaataacagatattaacgataatgcccctcgctttggagtagaggaactggagctaaaaatcagtgaaaccactacgccaggattccggattcctcttaagaatgcgcatgatgcagacgtaggtgagaacgcccttcagaagtacgcactcaacccaaatgaccacttctccctggacgtgcgaaggggagctgatgggaacaagtacccagaactggtgctggagcgctctctggaccgcgaggaagaggctgttcaccacctcgttctcgtggcttctgatgggggtgacccagtgctatctggcacctcccgcatctgcgtgaaggtcctggatgcgaacgacaatgcgcctgtttttacacagcccgagtaccgcataagcattccggagaatacgctcgtgggcacccggatactcacggtgaccgccactgacgcagatgagggctactacgctcaagtggtatattttctagagaaaagccctggagaaacctcagaggtatttgagcttaagtcaacatctggagaactgacaatcataaaagatctagattatgaggatgctacattccatgaaattgatattgaagctcaggatggtccgggccttctaaccagagcgaaggttatcgtcacggttctggatgtgaatgacaatgccccagaattttacatgacatctgctactagctcagtttctgaagactctcttccaggaaccataattgggctttttaatgtacatgatagagactctgggcagaacgcattcaccacctgttcactccccgaggatcttccttttaagttagaaaagtcagtagacaattactaccgactggttacaaccagagcccttgacagggaacagttttccttttacaacatcactctaaccgctaaagatggagggaacccctccctgtccacggatgctcacattttgctccaggtggcagacatcaacgacaacgcacccgccttctcccgcacatcctactccacctacattcccgaaaacaaccccagaggagcctctgtcttctcagtgacggcccatgaccccgacagcaacgacaatgctcatgtaacttactctttcgcggaggacactgttcagggggcacccttatcctcttacatctctatcaactccgacactggagtactctatgcactgcgctcctttgattatgagcagttgcgagacttgcaagtgtgggtgatagcgcgggacagcgggaaccctccactcagtagcaatgtatcattaagcctgttcgtgctggaccagaacgacaacgcgcccgagatcctgtaccctgccttccccacagacggttccactggcgtggagctggcgccccgctccgcagagcccggctacctggtgaccaaggtggtggcggtggacagagactcgggccagaacgcctggctgtcttaccacctgctcaaggccagcgagccgggactcttctcggtgggtctgcacacgggcgaggtgcgcacggcgcgagccctgctggacagagacgcgctcaagcagagcctcgtggtggccatccaggaccacggccagccccctctctccgccactgtcacgctcaccgtggccgtggccgacaggatccccgacatcctggccgacctgggcagcctcgagccctccgccatacccaacgattcggacctcactctgtacctggtggtggcggtggccgcggtctcctgcgtcttcctggccttcgtcatcgtgttgctggcgcacaggctgcggcgctggcacaagtcacgcctgctgcaggcttcaggaggcagcttgacaggcatgcagagctcgcactttgtgggcgtggacggggttcgggctttcctgcagacctattcccacgaggtctccctcactgcggactcgcggaagagccacctgattttcccccagcccaactatgcggacacgctcatcagccaggagagctgtgagaaaaaggattttttatcagcgcctcaatctctactcgaagaagaaagagaagaaacgttttctcaggtaatctatcttttcacaacatacgtactagctagtttgctgaagtaattcacttacttgtttactatatctattttgttccccatatttccttgagggtagagtcaagttttaggaagtgagtcttggtgaattatttcttggtaggtcttagtgttcacaggctgtaagaggaagaagagacgtgagaatctttgtgcaatgaatgtaaaccaggagttaatagataagattatccaaagagcactgcattaggaactagggtgtctggtttcttatactttcttctccatccctgggcaaatcatctcatccacccagatcaacaattttttctttgttaaaaatataaagattggagtttatgtttactcaagtcctttcttcttttaagttatgactcttactctatatttgaatctgtatatgaacagtgaaacatgttagttggctagttctttctcattcagtcttaatacatttctttcagtttggcagcaaaattgttttccttaacttgcatgcccttccctgttaaaaatatggaaatttagaaatatacattccttacagtgtttcaggaaggtatgtcatattattttggcttagttttaaaaatcacattaacctctaagctatatgcttcttgaagaagtgactgacttatcatctgctctataataaagctgtagagtggtaataaacaggtttctcctttttttttatctttctcatacgtgggaaccatactgtattttaatctttaaaataatatatatcctcaatatagttttgcttaaagaaaagatacaaaagattcatatcatacaattgcccagaaccaacttctttatacatctctcttctcaaggtttctactcacaatagctgctagaaatgttcccaatccctcacccaatcccagtgcccctctgatcaattttcttttcccattcctcttcctatattggcttttagtatgttggttatgtatttaataacagagaataataagcacactaatgttctatgtaactggcatcattttttatttttatttgaaaattatcatgtaccaattgagccttttattgaatgataccatatttctcaaagtgctgtgattctttccgttgcatttgatcaagaaaaaattttctgagacaaggtgttgttttggttactattacataattgtctatgagtaaaattggaactcactgtggaataatatgtcataatagctttacttgtaagtgaataataaagtataaacaggaaaattaaagcaaagttatttttagtgtgtgtagtaactccacaagaataaatgtcttatgcatagatatgtaatgcatcatgattgaaacgacaaatatattgtatttatatttctgtgcttggaaacttatggggaaagagattctggaacataaaagcttatttctactagtttcagttggttttgaaaaaacatccttacagtctagatttaaacaaaggaaacttctttcagtaccctgaaggtctgtgatttctctctcacacctaggcattgtcatgctgttctctcccacatccaggccttttcactgatccactcctctcatgtttcctgggaaagcgtttgctaacattaaaggcccaattgaaggcccccctaacccccttggcttctcccattatggtaattatctcagtacactgcaattccctgtttgcttttatatccttataatctctgtgaaggaagctactgtgtctatattgttcaccttaaatccccaaacatattgtctgatgcctaattatgtgtttgtttaatgaatattaaataacaacaaatatcgaaactaagttatcaggtcaccaagaacaaacttaaagaaatataatgtataaatatggctgatttctgtgtgtttcttttctttttttccttgtctcagctcttagagagttaagagtatagagagggaaaggtcaaagaggaggtggatatcttatcaaataaccctgataaatgtagtaagtataagaataaacacattatcaaggttcagtggtggaagaacaagtggtggtcatgtcttttaatagttgtgttggtccttacggccagttctttgttactgtgtgtttcttaaactgaacaattcaaaaaagttaactccactatgtttgaagcaatattggtggcattaaggttagtgcatggattcccaagaaagataacttgaggtgacactgtttaacatatatcgattcaattatgttcaatcaacactagtcctcttatctctgacaagaaggatttcagatcttggataattcaaaaataataatgtgtctgagaggatgcagtaaacggttaggcctcttagtgtcgctgttgaccactcaagaaggagaacgcagctggagaactagtccaccatttccttgctcctaaaatgcaaagaaccagcaaatcagactcagaagatccggggcggctgccaacctcacctcttagtcaaccagctgtttgacctgtgaattaggcccgtaaaagacttcgtttcttgagaaaataagattggagtccgtcgtaggaaactggaaccgaattcagagaaagcgattcaccgaaaaggaaatgaccaattgcctgagtttccgaaatggcagaggactggccctgctgtgcgcgctcctggggacgctgtgcgaaacaggatccggtcagatccgctactcggtgtctgaggagctagataaaggttccttcgtgggcaacatcgctaacgacctggggctagagccccgggagctggcggagcgcggagtccgcatcgtctccagaggtaggacgcagcttttctctctgaatccgcaaagcggcagcttggtcaccgcggagaggatagaccgggaggagctctgcgctcagatcccgctgtgtctggtaaaaattaacattctggttgaggataaattgaaaatttttgaagtagaaatagaaattaaagatattaatgataatgctcctaatttcccaacagaggaattggaaataaaaattggtgaactaacggttcctggaacccgatttccaattaaaactgcttttgacccagatgtaggcattaactccctgcagaactacaagcttagccccaatgactacttctctctggctgtgaatagcgtctctgagggggccaagtatccagagctggtgctggagcgggccctggaccgtgagaaaaaagaaattcaccagcttgtcctggttgcctctgatggtggcgaccctgtccactctggcaacttgcacatccaagtgatagtcctggatgcaaatgacaacccaccaatgtttactcagcctgagtaccgtgtgagtgtttgggagaacgtgcctgtgggtacccggctgctcacggtgaatgccactgaccctgacgagggattcaatgctcaagtgtcttatattctagataaaatgcctgggaaaatcgctgagattttccatcttaactcagtgagtggagaagtatcaatattaaaaagtctagattatgaggatgccatgttctatgaaattaaaattgaagcacaggatggaccaggtcttctttcaagagccaagattctagtcacggttctggatgtgaatgacaatgctccagaaattacaatcacgtctctcacaagctcagtcccagaagagggcaccgttggaagagaaattgctcttatcgacgtgcatgaccgagattctgggcagaatgggcaggttgaagtttttgtcctgggaaatctgccatttaagttagaaaaatcaatagatcaatattaccgcttagtgacggccacatccctggaccgcgaacaaatatcagaatataacattagtctgagagcctcagatgggggaagcccgccactgtccacagaaactcacatcaccctgcatgtgattgacatcaatgacaacccacccaccttccctcatttatcctactccgcctacattccagaaaacaaccccagaggagcctccatcttctcagtgacagcccaggacccagatagcaacaacaacgcccgcatcacttatgcattgaccgaggacactctccagggggcgcccctgtcctccttcgtctctatcaactccaacactggcgtcctatacgcgctgagatccttcgactacgagcaatttagagacttaaagctactggtgacagccagcgacagcgggaaccctccactcagcagcaacgtgtcgctgaacctgttcgtgctggaccagaacgacaacgcgcccgagatcctgtaccccgccctccccacagacggttccactggcgtggagctggcgcctcgctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagcctcgtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcaggctgcggcgctggcacaagtcacgcctgctgcaggcttcgggaggcggcttggcgagtacgcccggctcgcactttgtgggcgcggacggggttcgggctttcctgcagacctattcccacgaggtctccctcactgcggactcgcggaagagccacctgattttcccccagcccaactatgcggacacgctcatcagccaggagagctgtgagaaaagcgagcctcttctgataactcaggatttacttgaaatgaaaggagattccaacctacttcaggtgagtttatttatttctttgattattaagaacaaatatgagaatgtggttattataaagctttaacacatatgtatttgagaaataaagccatgaggttgtcattagtcctttgactaaatatttgtccccctttctttctgggcctatagtaggactgcactccccggtctggttatggttgagtgggcttagggaaaaaataatacatcgtgagtgaaagtaaagtgtcacttcctagaggaatctgccactgtgagaattttcagatctctaagttactatttgaaattgtgactgctccttctacctgggtccttgagtaactatgatgagagaaacacaacactggtttgtatacctgtgataaataggcctttttcattttaaatccctgtgctttggagtttgtcattccaacctgtatagcttatcctgatacatacaagtaaaaatacatatgaataaaagatattttatgcccatgaaattaaatgatgtttgactccttccaagacaggtgacactctttttttctttctccttccttccttcctctctctttcctccttccttccttcctctctctctttcctccttccttccttccttcctctctctctttcctccttccttccttcctctctctctttcctccttccttccttcctctgtttctctctttctttctttctttctttctttctttctttctttctttcttgacagggtcttactctgtctggagtgcagtggcatgatcacggctcactgcagccttgacctcgcagactcaagtgatcctcccacctcagcctcccgagtagctgggactacaggcacgagccaccctcccagctaatttgtttttgtttttgtagagatggggcaattgctatgtttcccaggctggtctgaaattcctgagctcaagtgatctgcccacgtcagcctcccaaagtactgcgattagaggcatgagccaccatgcctggcctgttattcttttcatctcaataacataaaaattggagaacaaaaatgtagaggctgggtgcagtggctcatgctgtaatcccagcactttgggaggctgaggcaggtggatcacttgaagtcaggagttcaagaacaccctggccaacatggtgaaagcctgtctctactaaaaatacaaaaattagctgggcatggtggtgggcgcctgtaatccaagctacttgggaagctgaggcagaagaattgcttaaacccaggaggcagaagttgcagagagccaaaattgggccactgcactccagctggggcaatagagagagactccatctcaaaaaaaaaaaaaaagtagaggctggtcaaatggttttacctatagtgcctgttacatatgcctaatgtatatgcttatgtgtgtattcattttgatttcaacattttgcctgagggtggaaagctcacctagctaaattattatgagccttggagtggtatttcttgtccttgagaaggacatcaaaaacatgtaaaggaatatgtctcagcctctgcgggagatttccagacaatctcttccaacaatggaatagaagtcccttcttttgtcatgttctacaactttcttgagccagaaattgttggcttattctgcaatttatgaaattattttcactcatgaaatcatatgagagttatccaaaattagaccaaaatatgttttattagaactcaaacaaaagaatagattcctccctcaatatattaggaaaaggcacatttaaatgtatgagacaacagggccagaacacaaaagctgtaagcagagtaaggtgtattctcactgaaacatggaaatacatcacagaatttaaaaggcccatagccaggggaggacttctgagcctaggactttgagacctacttgggcaacatagcatgaccctgtctcaaaagaaaaaggcacgtaacttttaacatatcatttttagaaaaaaaaatgtttatagtattagtatcactttccctgtaaggagaaaaaaaattaattagctgtgtcaggggaaatttggatgctcaaagataatttctaagaattctatatgaaacatagcctacatatgtgtcatgaaaatacactgagagtatggaacccatacaattccacctacttgtacaggtaatggaaggtctcagacatcccattttcactaaaaaggatttatttttatttttttgaagaatgggcaagaatccactacaacagaaagggaggagaagttcatagtaaaaggaatggaaagtataaaggcatgatgcaaggaaacaagtgaaaaggtatcttaagaaaacagataataggctgtttcgaatagagtatgagtatgggtgagcactgcaaaatagtagaataaattgttgagttggatctcatttggtaatgcatttgaaataaagggatttgctttgaaccaagactggttctaagcctggaactacagaataagttccaaaattgggtgtctaagaactctgaatacctctccaatatttaccagtggtcaagtcaaactcgttttgctcattaatggtataagtcggctggagctgagaattggcattatagagaatgtttttgagacagagtcttgctctgtcacccaggatggacttcagtggcatgatctcaactcactgcaacctctgcctcctgagttaagtgattctgctgcctcaacctcccgagtagctggcgttacaggtacccgccaccatgcctggataatttttattttttttagtagagatggcttgcaccatgttggacaggctagtctcaaactcctgacctcatgtgttcttcccaccttggcctcccaaagtgctgggatcacaggtcactgcacccagcctagagtatttaatatacattcatataaaaaagaagcactggtttcataaaacaaatgtacattatatgagattccacttcataaaagcatgtatgtgtaccccaacactaaattggcccttttaacaaaatatcagactttgtcctacttaactggaaagattatctatattttataaagaagagaaataacataatagtaaggctgtgatttcctcttttttgcaaaaactatttttgaaaagtattactgaattgataacatatatatggagagatttaaaatactagataagggagcttattccaatgaatttacagaaaggtaggtattttagtcaactaaaaatataaataaaaattatcaattcacttatttggatacagcagtcatgccagagtttataaatatagtgaaatcactgaagatttttttttacccccaaaactgaaaaaaatggcagtgtaccttgtgaattttttaaatgaaaaaagaatacgaaatgatgaaggcccttatctgatgatgacaaactagaaaactgaaatgtaaaggggaaaatgtgagtatgtgtttccctccagcaaattaaagacagggtacatagattcaagaggttgcgctttgaggataaaaagctgggccctgtgcagttttccaagacaacctctgggcgccgctgtcgaccaaaaggaagtgaaggcttctcaattctgcaggagcgtcaggcagggtgccttcctgctttgtccggtgcactgagcacagacgctgctcctgttcaccctcgagcgcctaactaataagtcctaagctcaaatcacagaagtccagggtgctgccatttctttttgaaaaacatcccagaggaaagaagctccgcggagagttcctgaaatgcagagagccagagaagccgaaatgatgaaaagtcaggtactgtttcccttcctgctgtctttgttctgcggggccatctcccagcagatccgatacacgattccagaggagctagccaacggctcacgggtggggaaacttgccaaggatctggggctcagtgtccgggagttgccaactcgaaaactgcgggttagtgcagaggattatttcaacgttagtttggagagcggggatttgttagtgaacggtaggatagatcgagagaagatttgcggaaggaaacttgagtgtgcactagaattcgaaacggtcgctgaaaacccaatgaatgttttccacgtggttgttgtaatccaagatattaatgacaatgcaccacgtttcgttgcaaaaggcattgacttagaaatttgtgagtcagccttacccggggtaaaattctctctggattctgctcaagatgcagatgtggaaggcaattcactgaagttatacaccatcaaccccaatcaatacttctctctgtcaacgaaggaaagtcctgatggaagtaaatatccggtattactgctggaaaaacctctagacagggaacatcagagctctcatcgcttaatcctgactgccatggatggcggggacccgcctctaagcggcaccacccatatctggatccgagttacggatgccaatgataatgctcccgtgtttagccaggaggtatacagggttagcctccaagaaaacgtaccgtggggaacctccgtgctgcgggtgatggccacagaccaggatgagggcattaatgcagagatcacctatgccttcctcaattccccaataagtaccagcctcttcaatctcaatccaaatactggcgacatcacaaccaatggcacattggattttgaagagacaagtagatatgtgttgagtgtggaagctaaggatggaggagtacacacagctcactgtaatgttcaaatagaaattgttgacgagaatgacaatgccccagaggtgacattcatgtccttctctaaccagattccagaggattcagaccttggaactgtaatagccctcataaaagtgcgagacaaggattctgggcaaaatggcatggtgacatgctatactcaggaagaagttcctttcaaattagaatccacctcgaagaattattacaagctggtgattgctggagccctaaaccgggagcagacagcagactacaacgtcacaatcatagccaccgacaagggcaaaccagccctttcctccaggacaagcatcaccctgcacatctccgacatcaacgacaatgcacctgttttccatcaggcctcctatgtggtccacgtgtctgagaacaacccacctggcgcctccattgcacaagtaagcgcctccgacccggatttgggacccaacggcagagtctcctactctattctggccagtgacctggagccgcgggagctgttgtcctacgtgtccgtgagcccgcagagcggggtggtgttcgcgcagcgcgccttcgaccacgagcagctgcgcgccttcgagctcacactgcaggccagggaccagggctcccccgcgctcagcgccaacgtgagcctgcgcgtgttggtgggcgacctcaatgacaatgcgccacgggtgctgtaccccgcgctggggcctgatggctccgccctcttcgatatggtgccacgcgccgcagagcccggctacctggtgaccaaggtggtggcggtggacgcagactcaggacacaacgcttggctgtcctaccacgtgctgcaggccagcgagcccgggctcttcagcctggggttgcgcacgggtgaggtgcgcacagcgcgtgccttgggcgacagggacgcggcccgccagcgcctgctggtcgctgtgcgtgatggaggacagccgccactctccgccaccgccacgctgcacctaatcttcgcggatagcctgcaagaggtattgccagacctcagcgaccgccctgagccctctgacccccagacggaactgcagttttacctggttgtggccttggccttgatctcagtgctctttctcctcgcggtgattctagcgatcgccctgcgcctgcgacgttcctccagcctcgacactgagggctgctttcaaaccggtctctgctccaagtctgggcccggggttcctcccaaccacagcgaggggactttgccctattcctacaatctatgtattgcctctcattctgcaaagacagagtttaattctctcaacctgacaccggaaatggctccccctcaggatctgctgtgtgatgatccttctatggttgtatgtgccagtaatgaagatcacaaaatcgcttatgacccttctttgtcttcgcacgtgagtttctgcaaatctagttaaattttatatatggcggccgggcgcggtggctcaagcctgtaatcccagcacttaaccaggctgaggcaggtggatcacttgaggtcaggagtttgagaccagcatagccaagatggtaaaacccggtctactaaaattacaaaaattagttgggtgtggtggcacgcgcctgtagtcccagttactcaggaagctgagacaggaggatcgcttgagcccgggaggtggagattgtagtgagccaagagtgtgccactgcactccagcctgggtgatgggagggaaactgtctaaaaaaacaaacaaacaaaaattatatattgcattttcttctcattggtgtataagtaattttgattttctttcattgttctagtgatggtatctactgcgggagggggtactagatagatggagattgctttcttgattgctcagtagtcttggcaatttaattttcaatctttactgttggcatttctgtatggttggcaaatcttgctaaagagacctgtttcctagatgttaacacttagtaatagcagtgccttttcttagttgatatgcaatactatattttcaagtcattttattcttagctctttataaatgtatttagagttcttcccacccaagttaaagttcatcaattacattaattatgtaattgatgtaattatgtattaatgtaattatgtaattaatgtaatcttcatcaattacattctagtttgtctttttgcagcaacatgtatgtttaatacagccttccaattattaagactcttaacactttgtctcatcacaagtagcaaatattgtccaattttatatttgcatcactaactttgagtcaatattattcccactctataatttcagtcaatgatatttcataattttcttaaccattcctaaattatttgtttttatgctctttctattttgtctctattaaaacaaagaatgtaatgaacatttgggtttataaagcgttttccatacttcttgtttctttagtgtagatttctgaggaattagttaaatctataaacatgttgagatttttttaatgcatactgtcaaatttatttccaaacatcttatttcacctctcaatcatccgcagtttgtgcggtctttgaggattgtgaaaaacacgtttaatctactctctcaaagtctgagggtttttaaattctgtatagctaatgcccttttgtatgagtcatttctactgctaattgttaagtgaggaataagcttaagaactgatgtactgctttatctcaaattttcacagattagtaaattactgtaagtattcataagaaagaaagcgatggcacatgcaatgataatccatgttcggctaccaaaacatttccttttactggctatttctaaaatgagagctaaagtaaagttagaaattgtaaaataatactgaatgtgtcatgtgaaaaaatcactaaactattatctgcactttatagttattcagtctaacttttctttttatttcttttttatttttaagatcagagttatttacccattgttttaggctttgcatttgaactggtcattcatgaaacattgaaaggtttcataaaaattactactctatgaaaggtattgttctaaagattgagaacacattgtgaacaagatagtcatatgcatagcttgtggccaagaatctactgtacacaaaattaaggagcaaattctcttcccaaacctattatcctatttgtcaatctcatttgtacagggtaaggctaactcttgaacagtaggtgagttttttgcaagggaattgaagcattgccccaggttctagagggtcaactcctgtgaggaaacttgttactgcataaattgggactaaagccagacctccaagttcctgtcccactgtcttttcacttatctgtctcatccatttttcaagtccacctttgtctttaggagagataattatgtccctcacacaatacgctatactgagaatgggctgtggggatgaacaatgtgaaaactgaaaagaggaagaacacatcttaggaaaaaaatcgtcatattttctctaagaaaataaataacttcataaagtttattgtacaggaagacttggatcattcttgaattttcattgcaaatcaaaaacaggaatttgactttattatcttgggagaaataggaatagaaaagtgtataaaaaataaactttttttaaccaagaataaattgcagtaacaggttaagactctgggtgtcgctgttcaccaatcagggggaaaagacaaaccagaaatttaatcagaatcacaagatttctgcagcacaaagcactggctctggagctttatgaaagcttcaagcggaagccctgagagctctggctgtgaatgcactttattttggacccagaagatcctggggctcctcaggcctcgacagagggaaaaccgaagcacaggcgactccgcggcggggttgtaatggcggcgcctcctgctcgcccagaccacacccggctgctccagatctgccttctcctgggggttctggtggaaatcagggccgaacagattctctactcggtgtttgaggagcaggaagaaggctcagtggtgggcaacatcgccaaggacctggggttggcgccccgggagctggcggagcgcggagtccgcatcgtctccagaggtaggacgcagcttttcgccctgaacccgcgcagcggcaccttggtcaccgcgggtaggatagacagggaggagctctgcgacagatctccaaactgtgtgacaaacctggagattcttctagaagatacagtgaagattttgcgggtagaggtggaaataatcgatgttaatgataacccacccagttttgggacagaacagagggaaataaaagttgctgaaaatgaaaatcctggggcaagatttcctcttcctgaagcttttgatccggatgtaggtgtaaactccctgcagggttaccagctcaactcaaacggttacttttccctggacgtgcaaagtggggccgatgggattaagtacccagagctggtgctggaacgcgctctagatcgcgaggaagaggcggttcaccacctcgttctcacggccttcgatggaggtgacccggttcgctctggcactgccaggattctcataatacttgtggataccaacgataatgctcccgtgttcactcagcccgagtaccacgtaagtgttcgtgagaacgttcctgtaggcactcggctactcaccgtaaaagccactgatccagatgaaggagccaatggagacgtgacgtattctttccggaaagtaagagacaaaatatcacagctatttcagttgaattctctgagtggggatataacaatattggggggtctagattatgaggactctggattctatgacatagatgtagaagcccatgatgggcctggtctccgagctagaagcaaggtactggtgacagttctggatgaaaatgacaacgcaccagaagtcacagttacatctctcaccagctcagtccaggaatcttcttccccgggtacagtaattgcacttttcaacgtgcatgacagtgactcaggaggaaatggcctagtcacatgttctattccagataatctgccattcacacttgaaaagacctatggaaattattatcggttgttgacacacagaacactggacagggaagaagtctcagaatataacatcactgtaactgccactgaccagggaactcctccactgtctacagaaactcatatttcactgcaagtgatggacatcaatgacaacccacccactttccctcatgcttcctactctgcttacattcctgaaaacaaccccagaggagcctccatcttatctatgactgctcaagaccctgacagtggtgacaatgcccgaatcacttactccctggccgaagacaccttccagggtgcacctctgtcctcctatgtctccatcaactccaatacagggatcctatatgctctttgctccttcgactatgagcagtttagagacctgcagctgctgatgacagccagtgacagtggagaccctccactcagcagcaatgtgtcactgagcctctttgtgctggaccagaacgacaatgtccctgagatcctgtaccccaccttccctactgatggctccactggtgtggagctggcaccccgctccgcagattccggctacctggtgaccaaagtggtggcagtggacagagactcaggtcagaatgcctggctgtcctacagcctactcaagtccagcgagccgggactatttgcagtggggctgcacacaggcgaggtgcgcaccgcacgggccctgctggacagagacgcgctcaagcagaggcttgtagtggtcgtccaggaccatggccagccccctctctcggccaccgtcacactcactgtggctgtggccgacagcatcccagatgtcctggctgacttgggcagcctcaagccttcagcagacccagacgactcgggcctcacactctatctcgtggtggcagtggccgctgtctcctgcgtcttcctggcttttgtcacggtgctgctagcactcaagctgagacgctggcacaagtcacgcctgcttcacgctgaaggcagcaggttggcaggtgtgcctgcctcgcactttgtgggcgtggacggggttcgggctttcctgcagacctattcccacgaggtctccctcaccgcggactcgcggaagagtcacctgatcttctcccaacccagctatgcagacacgctcatcagccgggagagttgtgagaaaagcgagcctcttctgataactcaggatttacttgaaacaaaaggagaccctaatcttcaggtgagtcaatcttataatagatcataccacactgaaatatagacaaagagttgtgtaaatgtctctcattttatatgtaatatatcaaataaagttgcctcttttaatattttattgctttaaagaaaactggtggatgaccttccaataatgatcaacagtatttaccacacaaaaatgttgtttattacttatcctttttggtcttcattcagttgtagtttcagccagaattttctaattttacaactctgagccacctcatttccttaaatttccttttctgtgctgggtgtggtggctcacacctgtaatcctaacactttgggagtgtgaggaggacggattgcctgagctcaggagttcgagaccagtctgggcaacatggtgaaacccagtctctactaaaatacaaaaagttagctaggcgtggtggtgtgtgcccgtagtcccagctaccctggaggctgaggcatgagaattgcttgaacctgggaggcagaggttgcaatgagctgagatcatgacactgtactccagcctgggcaacagagcaagcctctgtctccaaaaagtaaaataaaataaagtaaaataaagaataaatttccttttctcttaggtgttcctgaaaagatacaagagacctgtaaaatagaaggcaattgtgtaaattcacatttacaatattctttctcatgaagctattgttggatctggactgagggttttttaatttcctattttcacactctaccatgctttgcttgaagtttacttttccttccttgaaagggtattttccattataacaggcaacgtcaatttaagaatactggcaatttgtgagtttaacttttagatataactttaacaggatattttctcaatgaactggtatatttcaaatattttcttgttgctgttctgagatgcaccagaagtgactatgtgtgattcctctggtgcactcctgtgattatgagaaatatttccaagctaatttcagtcatatataagtagattctaggagtaactttaataatttttaaattgcttatcatgacatcactattgagactttcttgatttccaaggaaaatataagtttttggagtcttttctcttgtcatcatgtgagcctctttcaaaggttgagttacttgggttctggactgatatgatttacgctgcttagtaaggtggcctcatccctattgctacaaattgctttcagatatttctgtcatcatgtggctctgggattattttatatgagggaaaatattttgtgtgtaggggatatacaacacttttgttctttgtgctttcatttaggttctgtgagaattcaaaattcatgaatgcatatgcttacacaaattagtgtaatttgataactggaagttgtagtgatagactgtggaatatgcctcaatttgacttacaaaggagagttttagtttctacatggttttgtattcatagaaagttgtggtgcaatacatagagtaagctggaatatgatatgatgcagttacctggcttggggagcagaaagcagaaataacaagtgaatgttgagagacaacttacatctgaggagagattgtttaaagtaattaagccataaaatataatttggaaatgctcaattggtctgaaactgtgtcaagcatattcaggtgttggcattaggaatatattccagaatgagagtgccacatgttttaaaggcctaggaaagcagtagataatttataacctaaaatcaaattttttaaaaaatgtgtttttgttagaatgggcagtgggtttcttttagcaaataacaattttgattaaacaaattgttgtatattcatattacggactactagataactatattatgggccactagataactataagaaataaataggaaagctctctatgtactgatatgatctttaagatataacaactaaaaaagcaatgtgcagaatatggtatgttgtatgcttacatttgtgtaaagaaggagacagaatatttataaaaatccgttgccctatacaagacatatctccggaaggatacctaagaaactttaacactcatttcccctgtgaaagcatttctcctcatctaaagcagagatgaaaggaagaacctatgctgaatgcatcttttgaatttggaactatatgaatatttcacatattttaaaacaaatgaagactttataaattaaaaaagaaaagaaaagaaaaaagttcttagcaaatattgacaagccattagtgcagtttcctgagaaaacctctgagcgtcgctgttggtcaaaagaacgaagagaagcgtttgggagcctcttagaggggaacttcctgcacaaaccaaccacacagagaaggccagtatagattcggaaacagaaaacaaaagcaggaaaagtgaccttagcccggattctgccatccccggaaggcttattcctcctatgggcaaaggagcaaagggagccagaagatgaaagcgagctcagggaggtgcgggctggtgcggtggctgcaggtactgttgcccttcctgttgtctttgttccccggggctctcccagtccagatccgctattcaattccagaggagctggccaaaaactcggtcgtaggaaacctcgccaaggatctggggctcagcgtccgggacttgccagcccggaagctgcgggttagcgcggagaaggaatatttcacagtaaacccagaaagcggagacttacttgtgagtgacagaatagaccgagaacagatatgcgggaagcagcctctgtgtgttctggatttcgatactgtcgctgaaaatccactaaatattttctacatagcagtaattgtgcaggatataaatgataataccccgctattcaaacagactaagattaatttaaaaattggcgaatccactaagccaggtacaacatttccacttgacccagccctggattcagatgttggtcctaactcactacaaagataccaccttaatgacaacgagtactttgatctcgctgagaaacagactccagatggtcgtaaatatcctgagttgattctaaaacactctctggacagagaagagcacagtttacatcaattggtcctcacagctgtggatggcggagacccacctcaaagtggcacgacccaaatccgaatcaaagtcacggatgccaacgataaccctccagtgttcagccaggacgtgtacagggtcaccctgagggaggacgtgccgccgggcttctttgtgcttcaagtgacagccaccgaccgggatgaaggcataaacgcagagatcacctactcctttcataatgtggacgaacaagtgaaacactttttcaacttaaatgaaaaaacaggagaaatcacgacaaaggatgatttggattttgagattgcaagtagttacactctgagtatcgaagcaaaagatcctggagatctagcagcccactgcagtatccaagttgaaattcttgatgacaacgattgtgcacctgaagttattgtgacttcagtatctactcccctaccggaggattcgccaccaggaacagtgatcgccttgataaaaacgagagacagagactctggagaaaatggagaagtttactgccaagtgttgggaaatgccaagtttattttgaaatcttcctcaaagaactattacaaactagtgacagacggcgctctggaccgggaggagatcccagaatacaatctcaccatcacagccaccgacgggggcaagccgcccctctcctccagcataattgtcaccctgcacatctccgacgtcaacgataatgccccagttttccaacagacttcctacatggttcacgtggcagagaacaatcctcctggcgcctctatcgctcaaatcagtgcctctgaccctgacttgggccccagtggccaagtttcctactccatcgtagcgagcgacctgaagccgcgggagattttatcctacgtgtccgtgagcgcgcagagcggggtggtgttcgcgcagcgcgccttcgatcatgagcagctgcgcgccttcgagctcacactgcaggcccgcgaccagggctcgcccgcgctcagcgccaacgtgagcctgcgcgtgttagtgggcgacctcaatgacaatgcgccacgggtgctgtaccccgcgctggggcctgatggctccgccctcttcgatatggtgccacgcgccgcagagcccggctacctggtgaccaaggtggtggcggtggacgcagactcaggacacaacgcttggctgtcctaccacgtgctgcaggccagcgagcccgggctcttcagcctggggttgcgcacgggtgaggtgcgcacagcgcgtgccttgggcgacagggacgcggcccgccagcgcctgctggtcgctgtgcgtgatggaggacagccgccactctccgctacggccacgctgcacctaatcttcgcggatagcctgcaagaggtattgccagacctcagcgaccgccgggagccctctgacccccaggcaaaactgcagttttacctggttgtggccttggccttgatctcagtgctcttcttcctcgcggtgattctggcaatctccctgcgcctgcgactctcttccaggtcagatgcttgggactgttttcagcctggtctcagctccaagcctggacctggggttctccccaattacagtgagggtacattgccctattcctacaacctgtgtgttgcctcacaatcagccaagacagagttcaattttctgaacataaccccggaattggttcccgcgcaagatctcgtctgtgacaatgcctcttgggaacaaaatacaaatcatggagccgctggggtcccttttgcctcagatactattttgaaggtgagctttaattaatttattttcacttctggttttattgtttcacctaatttgggtaggaagttccactgcgtatttctttgtctgtgagttagatttggccaatgttgtgccttaattgtcttaatcttatctaactgaattttaagtgttttctctctgaagtgtgagatttatttacccatgattgcaaacctttatcacatgagatattgcactgtatttctttttcttcctcatctttacattacttctctctgcagatttgttgctattgagactttaggcaattagtttcaccttcaggctctttgttattcaaattttagttttacttcctcttagaatcataatacttcagagtaaagagagtcttcattttagtaggctttggaaattgggaaacaaagaagaaagacttttgcataatggcatggcttgttaatcacagggcatgggtaggacattgtcccattgacttgaagaccaacactcagtaagctaaatgtcttggaatcacaaatgtatttctaaaggacaggcaatgtttgaggtctgaggtgtctgctagaaagagtgcatttaacaaatgtgagaaatcattctctaacatgcattttaacaaattgctcttaagaaaaactacacattgagaaaaatcttacaacctatgttcacatcattttctacaaaatattacttaaaactttgcttttgaatttcctaattatatagaatttttattttcttagttttctatgaaagtgttattaaataaaatgactttctgaaatgtccatttttttcaatcaagaggtttttctatttctgttgtcatataaagatgatagcagtaaatatctgtctcaacatagaaaggtcactcagtacttctcgacaagtatctgctcatgctttcctgcatggatgatgaaataaaaccccatcctccacagttactatactggttgtcactggaactacaaatatttgaacatggtaatagaaaaacataaaaatgcatagttaacccaactcaaacgctgtctgagatagtggagagactttctcaaagtcctcacaagtaacaaagatctttatttcttctgcatatgacagctaatataacttacataaatcagtaggcctgtttggaaaggtgcatggagaactgggtttgtttccttggtattcttatatgcaaataagcacgttttcctaaatttatcctaataaggagatgaaatcttgaatcctacaaaggtaagaatttgaatgtcctaatttaatggactaaatatagataagaggtaaataaaggacataggctcccccgatgacgcattaaataaaatttttgtaaggtattgagatctaataatcatattgatctcagggattgtggaagtcttgctattcagaattaaagctgaattaacggtcataaacaacgctacacagttaaacattaaggatatggcaacattattagaaataaaattataactaaacttaggagaaataaaaatggaatttgatgcagtcactggttaggactctgagtgtcgctgttgaccaaagtgggaaagaagctgccgcagaggcgacccgactctgctccctccatactaaacacacagaccagacaagctcctacgaaaagccaacgctccacgcccattttcgtcagggaatatgtacccatcggctttagataaataaggaaacagcaggctgaaccagaactaagagaaaattgggcagagagaaggcaatggcgagtccacctaggggctggggctgcggagagctgctgctgcccttcatgctcctggggacgctgtgcgagccaggatccgggcagatccgctactcgatgccggaggagctggacaaaggctccttcgtcggcaacatagccaaggaccttgggctggagccccaggagctggcggagcgcggagtccgcatcgtctccagaggtaggacgcagctttttgccctgaacccgcgaagcggcagcttggtcaccgcgggcaggatagaccgggaggagctctgcgctcagagcccactgtgtgtggtgaactttaacatcttggttgagaacaaaatgaaaatttatggagtagaagtagaaataatcgatattaatgataacttcccgcgtttccgggatgaagagttaaaagtaaaagttaatgaaaatgcggctgcagggacacggttagtgcttcccttcgcgcgggatgcggatgtgggtgtgaactctctccggagttaccagctcagctccaatctgcacttctctctggatgtggtaagcggaactgatggacaaaagtatccggagctggtgttggaacagcccctagaccgcgagaaagagactgttcacgacctcctcctcacagctttagatggcggagacccggtactctccggcaccacgcacatccgtgttacggtcctcgacgcaaacgacaatgcgcccctgttcaccccatccgagtacagcgtgagtgttccagagaacatacctgtgggcactcggctgctcatgctaaccgccacggatccagatgagggaataaacgggaaattgacctactcttttcgcaatgaagaagaaaaaatttcggagactttccaacttgattccaacctgggggaaatctcaactctacaatcactggactatgaagaatccagattctacctcatggaagtggtagctcaggatggaggcgctcttgttgccagcgctaaggtggtggtcacagtacaggacgtgaatgacaatgcccccgaagtgatcctcacctctctgaccagttcgatctctgaagactgtcttcccggaactgtaatcgcgctgtttagcgtacatgatggtgattctggagaaaatggtgagattgcatgctctattcctaggaatttgccttttaaattggagaagtcagttgataattactatcacctattaacaactagggacctggacagagaagagacttcagattataatatcactttaaccgtcatggaccatggaaccccgcccctctctacagaaagccacatccccttgaaagtagcagacgttaatgacaacccacccaatttccctcaagcctcctactccacctctgtcacagaaaacaatcccagaggtgtctctatcttctctgtgacagcccatgaccccgacagcggcgacaacgctcgagtcacctactccctggctgaagacacatttcagggggcgcccttgtcctcctatgtatccattaactctgacaccggtgtcctgtatgctctgagatccttcgactatgagcagttgagagacctacagttgtgggtgacagccagcgacagtgggaaccctccacttagcagcaacgtgtcgctgagcctgtttgtgctggaccagaacgacaatacgcctgagatcctgtaccccgccctccccacagacggttccacgggcgtggagctggcgcctcgctccgcagaacctggctacctggtgaccaaggtggtagcggtggacaaagattcaggccagaacgcctggctgtcctaccgcctgcttaaggccagcgagccaggactctttgcggttgggctgcacacgggcgaggtgcgcacagcgcgagccctgctggacagagacgcgctcaagcagagcctcgtggtggccgtcgaagaccatggccagccccctctgtcagccaccttcacggtcaccgttgccgtggccgacaggatccctgacatcctggctgacctaggcagtatcaagacccccattgaccctgaggatctggacctcacactctatcttgtggtggcagtggctgcagtctcctgcgtcttcctggccttcgtcatcgtgctgctggtgctcagactgaggcgctggcacaagtcacgcctgcttcaggctgaaggcagcaggttggcgggtgtgcccgcctcgcactttgtgggcgtggatggggttcgggctttcctgcagacctattcccacgaggtctccctcaccgcggactcgaggaagagtcacctgatctttccccagcccaactacgcagacacgctccttagtgaagagagctgtgagaaaagcgagcctcttctgatgtctgataaggtagatgcaaacaaagaagaacggcgagttcaggttagttttctctttcggtaaggatgaccagaacattttcatttgtttcctttttcatgtttctgtcatattcagaatcagctagttatgtaaatagtggaacattatttgctgtattggagattaattttttttatataattcatgctttctccatttgttttcaaattctgttttgggaagtctagctgatatctgtagacttaagtgaaacaaataccttaaaggaaagtggttaaatataatcattttacccaaatattttgttatattggaactgcagttctattaatagaaaagatgttttatttattcaaattgttagatatattgttctcttttgagtgtctgcctagacaccattagtgaatgtgttttggaaaggataatgtataggactgatattttagtctacctgaaatttgtttaaggaaataatttacagtatttacataaatcagtggaaaggtacagagaacttctgggtcataaatatcagaaaagaggccgggtgcggtggctgacgcctgtaatcccagcactttgggaggctgaggtgggcggatcacgaggtcaggagatcgagaccatcctggctaacacggtgaaaccctgttctactaaaaatacaaaaaattagccgggcgtggtggcaggcgcctgtagtcccagctactcggaaggctgaggcaggagaatggggtgaacccgggaggaggagcttgcagtaagccgagatcgcgccactgcactccagcctgggagacagaacgagactccgtctcaaaataaataaataaataaataaataaataaataaatatcagaaaagtagataaaatttatattaatgataacatgtagcattctaaagtctggaaagtttgtgttaagccatgtagttattggatatgtgggcttgttgagagaagaaatcagtgtaaaggaaccttaaggttgggcttcgttctgtgatgtaaagcctccagagagttacatactgctgcactcaataaatgtaaatatgtcacacacctggcatcttctgttatagataaaccctttacttattagaatcaatacctactgcaatgttagcgtttctttaagtgtaggtgcaattcttctttattacttgagtttaaggttgtatttgaaaaaaaaagaactcaacttaaagatggttcaaaattttaaatttcatatctaacgtatgtgctcatcttaaattaatagatttgtcttaatgaaatactggcctatgtgcctcaaattccaggaggatgtgttatgtaatgaaagaactactatatttcccttctgcatctgatttgctgaagatgattttcagatgtttcttattaaaatattcttaatccttcaaattttgtacttttaaaaccttgagcatcagcttcaaataatgactaaataaggggaaaaggtaataaaatattacaaatgggatagtaagctacattactcaaccacatgaaaggttaattgacacattaaagaacctaagaccacttgatttttattttttaaacactgttaaagagcattcaagtatatctatatctatatacatatacacacacatatatatacacacatatatatacacacatacacacacacaaacacacatacatacacacatggacattctgaccaaaatgtaaaatgtacaaactcaccgaatagtgaatgcatccaaagagtaacaagagaatctatacagtaggtgtcgacattattcactcctatgtgaaaacttgcttttccattttttttaaaagaaaatgttatatgcttcttagggtaaggtgtttgggaaaaaagtaaaggttatagatttgggtacatttcttctgagttaaatgttttgtgcaatggaaaaatatctttaaaccctctataaactactaacagactataaaatgcttgatccatacattttgaatgtatgtactgtatataccatatacttttaaatatctgaatctttagttttatatgtgttctgaagaataatttttcatactaattgaagtgttcatacaatgaacacttggcattgtgttggaaggcacttgctttggaatgttttggagcaaagtcttgagtcagttatatttttgatgtttgtataaaggtgacaatgagtgtctgtctagaattctggttactgtgagtagtttaagatgctataatgcttttccactataaggtgaattcggtgtggaactcattgcttattgctgcacacttgcctagttttagagtaacaatacattatgtaggctaaagataatttctttaggaagattttctggtttgaaaatggaattaaaactgtaagacacctgtcagaaacatggaaaatggcatgttattgaccagggaaaagtgtaaataacaaaaagttaggattatcagatggtaaactggggaccaaggaaaagtggacaggaagattacttatataattaaataatataattataaggacttacaattcactccccaatcctaataacgcatcattgttaggctacttgagaagaaacagtacatttcaggacaattgtgatgtagtatgaaaaaacatcctttgtaaaagtttttcatttgggccagggtggttcatgactataatcccagcaatttgggacgctgaggtgggaggattgcttaaagccaggtgttctagcccagcctgggcaacatagtgaaaccccacctctatagaaaaaaaaagttttcaatcatacttatttaattaaaagtagacacttggaaacaaaggaaaagagaccctcttgctttttactatacttctattttataaggtcaatcatttcctcattacctttaacttcttttggggggagataataaagataaaagagaagaaagtgaaacatagaataaaactaaaagctatgacattataacttttagaagttagaagtaaaggaaatagaatgcaataagaatacacgtgaagctgatatttcaagcctctttatactacgtcttctgccatcaccaaaaatagcttccatttgtatgattttctatgtattattttatttggccctcatttctactagagtaagcagagaagatattattatgaccattttatgaaaatggaaactaaaaacgtgacgggattgagcaagattatctctgccctttgacaagtaaaaggtacttgatttggatggataaagctcaaattaaaagaaataacagactaaagatatagtaagtatatttaatgttttttaaaagtccttttaaaatgggaagaaagtatcactatcagtacactgccgatttttctcctaactagctccttatttggagctgatttagtcaccattactgcagttctgcagcagaggcgccgggtgccgctcttggctagtgctgtgcaaaatattggctcctcccgctgcagccagctcggaagaaaagtgcactctctatcaggcttcctgcagcggagacacccattagagaacccaagcacaaagacaaagcaaatagttggtcctgctcggagaactcttgggattatttaaagatctcctctcctcggatttagaaaggcaaaggcgcagagagcgggatgggaaatagctccggatggaggggcccagcagggcagaggcgaatgctatttctcttcctgctctctttgttagaccaggctctctccgaaccgatccgctacgctattcccgaggagctggacaggggctcgctggtagggaacctcgccaaggacctggggtttggcgtgggggatttacctactaggaacctgcgggttattgcagagaagaaattctttaccgtgagccccgaaaatgggaacttacttgtgagcgaccgtatagaccgagaggagatttgtggcaagaagtcgacgtgtgttctggaatttgaaatggttgctgaaaagcctttaaacttttttcatgtaactgtgctgatccaggatattaacgacaacccaccgacctttagccaaaatatcactgagctggaaatcagcgaactggctctcactggagccacatttgccctggaatctgcgcaagatcctgatgtaggtgtcaattcgctgcagcagtactacctcagccctgatccgcacttctctttgattcagaaggagaacctggatggcagtaggtacccagagctagtactgaaagcacccctggacagggaagagcagccacatcaccacctggtcctcacagctgtggatgggggcgagccctccagaagctgtaccacccagatcagggtaattgtcgcagatgcaaatgataaccccccagtatttactcaggacatgtacagggtcaatgttgcagagaacctgcccgctggctcctccgtattaaaagtgatggccattgacatggatgagggcatcaatgccgaaatcatctatgccttcatcaatattggcaaggaagtgagacaactgttcaagctggacagtaaaacgggggaactcaccactattggagaactggactttgaagagagagatagctacacaattggggtggaagcaaaggatggtggacatcacactgcatattgtaaagtacagatagatatttcagatgaaaatgacaatgccccggagataaccctggcttctgaatcccaacatatacaagaagatgctgagctggggactgccgttgccctgatcaaaacacatgatctagattctggatttaatggagaaatcctatgccaactaaaaggaaacttcccctttaaaatcgttcaagataccaaaaacacatacaggttggtgacagatggagccctggaccgggagcagatcccagaatacaatgtgacgatcacagctaccgacaaaggcaatccaccgctctcctccagcaagaccatcactctgcacatccttgatgtcaacgacaacgttcccgttttccaccaggcctcctacaccgtgcatgtagctgagaacaatccgcctggagcctccattgcgcatgtcagagcctcggatcccgacttgggacctaatggccttgtctcctactacatcgtggccagtgacctggagccgcgggagctgtcgtcctacgtgtccgtgagcgcgcggagcggggtggtgttcgcgcagcgagccttcgaccacgagcagctgcgtgccttcgagctcactctgcaggcccgcgaccagggctcgcctacgctcagcgccaacgtgagcctgcgcgtgttggtggacgaccgcaacgacaatgcaccgctggtgctgtacccagctctggggcccgaaggctctgcgctcttcgatatggtgccgcgctctgcagagcctggctacctggtgaccaaggtggtggcggtggacgcagactcgggatacaacgcctggctgtcctaccacattgtgcaggccagcgagcccgggctgttcagcctgggcctgcgcacgggtgaggtgcgcacggcgcgtaccttgggcgacagggaggccgcccgccagcgcctgctggtcactgtgcgtgatggaggacagcagcctctttcagccaccgtcatgctgcacctaatcttcgcagatagcttgcaagagatacaacctgaccttagcgaccgccccactccctctgaccctcaggcggagctacagtttcacctagtagtggcgttggccttgatctcagtgctcttcctcctcgcggtgattctggcaatctccctgcgcctgcgatgctcctccagacccgccactgagggctactttcagcctggtgtctgcttcaagactgtacctggagttctccccacctacagcgaaaggactttgccttattcctacaatccgtgtgctgcctcacattcctcaaacaccgagtttaaatttctcaatataaaggctgaaaatgctgcaccacaagatcttctatgtgatgaagcctcttggtttgaaagtaatgacaatccagaaatgccttctaattcaggcaatttgcaaaaggtgagtttcttcaaacctttccttccataaatataattgggtttcaattcattgatttagagataaaaagaatacagattaaatattccctgattacattattttattgattttctggtgtagagtagggtgtctaggaaattctttgtagaatttcctgtagaatatctgtgttgcagttgttctttcatagaaagcctccttttgatagtcttgaaacttttcttaatcctaatacactataatctgaaacatttttaatacagtattatctcacactgtcattttcagacatatctatccagaattagacccaaatcctcacaattaagtggtttacttagttttaatgcagtcaatcctaaaatatatgaaacattatgtatatcttaacacatttttaatgtaacctgtatataatatttttacttccctttgcatgtttttaaaagtatacacagatgttgcctatgtcagggcagtttttaacttctatgctaatcaaaagaaataatggcatctaaaatggcaactcttgtaatgggcactgtaatgaattggttcaaaatgtgtttgtgtagcatatgcctgtagtcccagctactcgggaggctgaggtgggaggatcccttgatcccaggaggtagcagctgcaatgagctataattgtgcccctgcactctagcctgggagacagagcgagactttgtctccaaaaaagtgtttgtggttgttggtacccttactgaaaatgggactagcataaatggtggtgaaatgtgatgataattcaaaatttacagaagattgtaatattatttctgttccccaaggtcctaagagatattttcataaaaatgaatggtaaacttcagagaacatttaaaattattcaaaataatctcttacactcttctaaatgcttcattatcttggggagggaaatattatgagtgtcatctctgcagatttagcagaaataaaatcctctgtgtgatagtttcacaaaacgatgcagtattaagttaggactctaagcgtcgctgttgaccaacctgggcaagaaaatcaacggaaactcaagttacatcctccaacaacaaagcaaattagacgggaaagcaggaaagctgtgcagaaattctgacctgaaacgcttcgcatccggtctctgcttgttgaaggaccttcaccgctatttctgagaagagcaaaagtgatgcagatctgttcttcctcttcttaatcccagagaagttcctaataagccagtaatggcgcctccgcagaggcatccgcagcgcagcgagcaggtcctgctcctcacgctcctggggacgctgtggggggccgcggcagcgcagatccgctactctattcccgaggagctggagaaaggctccttcgtaggcaacatcgtcaaggatctgggactggagccccaggagttggcggagcacggagtccgcatcgtctccagaggtaggatgcagcttttctctctgaatccgcgaaacggcagcttggtcaccgcgggtaggatagaccgcgaggagctctgtgctcagagcccgcggtgtctggtgagttttaacatccttgtcgaggataaactgaatctttatcccgtggaagtggaaatagtggacattaatgacaatacaccccgattcttaaaggaagaattggaagtgaaaattctcgaaaacgcagctccatcctctcgttttccactaatggaggtctatgaccctgatgtgggaatgaactcccttcagggatttaagctcagtggtaatagtcacttctcagtggacgtgcaaagcgaagcccatgggcccaagtacccggagctggtgctggagggcacactggaccgggaaggagaagccgtttaccgcctggtccttactgccatggatggcggcgaccctgtccgctcaagcgtcgcccaaattctggtaacagttctagatgtgaatgacaacactccaatgtttactcagcctgtctaccgtgtaagtgttcctgaaaacctgccagtaggcacaccagtgttggcagtgactgccaccgaccaggatgaaggagtccacggggaagtaacttattcctttgtgaagattacagaaaagatctcacaaattttctgtttgaatgttttgactggagaaatttcaacttctgcaaatctagactatgaggactcgagtttttatgagctgggtgttgaagcccgggatgggccaggtcttcgagacagagcgaaagtcttaataactatcttggatgtcaatgataatgtaccagaagtggttgttacatctggaagcagaacaattgctgaaagtgcacctccaggaacagtaatcgccctttttcaagtgttcgatcgagactctggcctgaatggcctggtaacctgttccatcccgagaagtctcccatttgaattggaaaaatcagttggcaattattatcgattagtgacaaatgcagctctagaccgggaagaggtattcttgtacaacatcactgtgacagccacggacaaaggaacaccacctctgtctacagaaacaatcatctctctaaatgtggcagacaccaacgacaacccgcccaccttcccccattcatcctactcagtctatgtccttgaaaacaaccccaggggtgcctccatcttctctgtgaatgcactggaccctgacgtggaccagaacgcccaagtctcctactcactggcagaagacaccctccagggggcgcccctgtcctcctacgtgtccatcaactccgacactgggattctgtacgccctgcgctccttcgactatgagcagttgagagacctacagctgtgggtgacagccagcgacagcggggacccgcctcttagcagcaacgtgtcactgagcctgtttgtgctggaccagaatgacaatgcgcccgagatcctgtaccccgccctccccacagacggttccactggcgtggagctggcgccccgctccgcagagcccggctacctggtgaccaaggtggtggcggtggacagagactcgggccagaacgcctggctgtcctaccgcctgctcaaggccagcgagccaggacttttctcagtgggcctgcacacgggcgaggtgcgcacggcgcgcgccctgctggacagagacgcgctcaagcagagcctagtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcagactgcagcgctggcacaagtcacgcctgctgcaggcttcgggaggtggcttagcgagcatgcccggctcgcactttgtgggcgtggaaggggttcgggctttcctgcagacctattcccacgaggtctcactcactgcagactcgcgtaagagtcatctgattttcccccagcccaactatgccgacacgcttatcaaccaggagagctatgagaaaagcgagcctcttctgataactcaggatttacttgaaacgaaaggagaacccaggcaacttcaggtgagtttctttccgcctaagcgggaagagtaatctgatcttcccgcaacccaactaatcagacaggctcatcagctagatcggctgttatagaagcgaacctcttttggtacaggaagattcgtgattttgtaaagtggaagactcccttgttcaggtgagggtatcgtttttttttttttttttttttgagacggagtctcgctctgtcgcccaggccggactgcggactgcagtggcgcaatctcggctcactgcaagctccgcttcccgggttcacgccattctcctgcctcagcctccctagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggccgagggtatcgtttttattggttgacaggaaaattcaagattgtctttgattagtgcttagttttcttagccctttgcagagagtcacataattctaatgtttttcttttatatcaaaagaatgttctgaagtcttaattttgtgggggaaaataatgcatgtcctagtttttctttacctttctcttcttggcaaactatttgtgtcttggattgagtacatctcgtttcttaggttttttcctactatgtgacatttgtaaggttctttctttttctaatgtgggaaaaaaaataaccttaatttaggtcagtgttaaagatcaagatcttggttttagctagcatggtggttcacgcctgtaatcccacctcttcaggaggctgaggcaggaggatcccttgagaccaggagtttgagaccagcctgggtgactctgtctctaccaaaaagaaaaaaaagtagccagatgtgtggcgtacacctgtagtcccagctactcgagaagctctgataggaggattgcttaagtccaggggtatgaggctgcagtgagatataattgtgtcactgcaccctagcctgggagacagaatgagactttttctctctctctctcaaaaaaaaaaaaagattttgttttttctcagtgttacttgataactataaacgacagacgttcatacaagagatctttcacctttactacttaggaatcaaaaattatttttgaaaagataagaatcattggtaactgcagcaggggacaccagatctttggtgttaaaagacctgaataacattcctgtaactatctgttatttacttgggccagttacaatcgccattatcttccaattaaaattaagatttaaaagacttctcttatcagagataggatccccctctgttgcccagtctggagtaaaaatccacctgtaactgctgcttatagagtgtgtatccagggcaacttgaatctatgttcctgggttgcaatcctaaagcttggctcaaataagctctacttatattattttttaaaacaagactttccttatctatctgactcaaattctaagaaaataattttataactttttttcaaactctaaagcagcatagtgaacacgtatttgttgacatcaccattattataattattgggttgttaacaataactaagcaccgatgctgtgtgcctactacagtgtcttttgcatactgtgtgcctgatagtatttaagagtgaaaatggccgggtgcggtggctcatgcctgtaatcccaacactttgggaggccaaggcaggcatctcacgaagtcaggagttcgagaccagcctgaccaacatggtgaaaccccgtctctactaaaaatacaaaaattagccaggtggggtggcatgggcctgtaatcgcagctactcgggaggctgaggcaggagaatcgcttgaacccatgaggcagaggttgcagtgagccaagatcgtgccactgcactccagtctgggtgacagagcgagactctgtctcaaaaaataataatgataattaataaataaagagtgaacatgaattttaaaacatgctcggtagtgtctgcttacaggacatatctctaaaaatagatgactgactggtgaatgggagaacaaatgttaatgaggttcaaataaaaatttaaatattttagcattttaacccagacaataaggctttcatcatataggaactctttattgaaatatttcaagaaaaaagggattatcatttagaagactgattagtcttatttattatgactgaaatgtgcaaacagaatcattgtttcatgaacagaaaacagcagagtttttgactgtcaatgatgttcgaatagaaaatggatcactaaggagataggagattctgttatcgacagtcttcaaaagtaagttgatggccctggaatgaatggagtacaggggattctctaatttgatgacttgttgaactacattatagtcaagatttttctccagtcatgagttggaagattctacaatctggtggtattatagaatggattggccacttgtgcatctgaatttgttatgaatgtgtaagaaaaaagcaattgagaagataccttgaaaataaatgagaacctcctttgtaacctgactttgtcagtcttcttaaagataacattgagttgatgtgtttttaaataagctgctaagagtaatatgtgtttttctgaaccaatattgtggtatttacatttaaggaattgttatagatttatttatttcaagtttccaaaggtatatacctaaacaagagatctaatcatacacatcttcaaagctcattttcttgtatctttgtgatataatttgataaaataacaattttaaacaacttgaatcttggatattagtctcatgagttagatgggctgttatacatatgattatttcataaactctgaaagtgtgaatgttattttactatactaccaatttgggatgttaaactacatcttgagcatttgttgttatagggaaagctcactaactacttttcatggagatcaggctggtttattttattctcttattacctgtgaccatttcatttaaacaaataaaatatttctctgatggaaaaactaccaacttctactctcacaaaagtcattcactcatgtggactgaccaactgttaaacatcctggcagtcatggaatttgctaagttatggctaaatgaggttctttaatccacctgcaatacagatcattaataataagataggctatctgaggttttgagagttcagtatagaattttgaagcatcaggaaaaaaaactaccaaattattgtcttattcttattttatggtctgtgaaagcctcttttttttttttttttttttttttttttttgtcagagtcttgctctgtctcccaggctggaatgcagtggtgtgatctctgctcactgcaacttcctcctcctgggttcaagcgattctcctgcctcagcctcccaagtagctgggattacaggtgcatgccaccatgcctagctaattttcatacttttagtagagatggggttttaccatgatggccaggctggtctcaaactcctgaccttaagtgatccacccgcctcagcctctcaaagggctgggattacaggcatgagccactgagcccggcctgaaaggcattcatttctgatcaggcttctgttgaggtggcaattgtcaaaggggaaggagtaaaatctcagaggagaaacattggaagatacctatatctttgcttgagaatgaaaatctaaatggaacttcaaagaactgttttgttgtttgttttttagaaaaaaaagtcccaaaaaagaaaagagagaagataatcaattcgatgcccaggaagccaaatagactttacatagaattctttttaatgcaaccaaacaaatggtcaggattcttcccaatatctcagtcaacaataatatacactctttaaactatgaaatgatttcaatttgatacaatgagcttatgttagattttattaaacatatcttggcggtctagtaaagatctttaatatttaattttatgatgttcgataacttagaaaatgtgaatgctagagacaatgaagccatttactccatagggtatgtatgctttgtgttcggagtagtctataatttaatttaactagctcttatttccttttctccaaagaaggtaccaagacactataaattaattgagacttttttaaaacagtagaataagaaacaaatgtgagatgaaactatgaattttgaggcatcaggtaaaaatggatcaagacattgagagctataacctccaaacatgaaagtttgtttgaaaatatctacaagtgcttacattgtttaataatcatacactttgcttgcctcaacaagaagttcaaaagtactattaaacaaatagaatttaactccagtttacagaattcatctataatacctctattagttcctttaaacaaaatttatctactttgtgaatgcaaagataactatggattattttgatagatcaaaacagaatgtccttcaaagtgttccctgtattctggagcaatgccaccagaaagcagaaataggttacttaggagcctcccacaaaacgaagttaagctttcttagtgttagttctggattctcctcctggttccaccaactactctccaggacctagaagaatttacaaaccaagactgtttcttgccaggtctttattccagagcaggtcattctcttttattctgcaactatgtgaaaggagctttcttttctttctgctagcagagggtagcctcggatccatcaataatttagttttactctatcaacatcagtggagagacgagtacctctaaggatcctgtcaggacagtcctgcattttgctcaaatgctgtctagagatccctgttttctcaattacactagaatagagtaggatgaagatttgaattgcatactaggatgaagacttgaattgaattgcataatgaaaagaatcagccaatccattatccagtttcttatgaattcacagcccagtaggatctctgcagatttctgccttctgtagaaaatgggttgcttctatagctgattgctgcagccaagacaaacaacgatttctttctttttttctcacaagactgggagtgagaatatttggattccgacattgttctactactatataatcaataatcaggaacaaggcaaggcaattccctctttctttctttctttctttcttcttcttttttttttttttttttttttggcagagttttgctcttgttgtccaggctggagtgcaatggtgtgatctcggctcaccacaacctccacctcccgggttcaagcgattttcctgcctcagcctcctgagtagctgggattacaggcgcgcgccaccacgcccggataattttgtatttttagtagagacggggtttctccatgttggtcaggctggtctcaagctcccgacctcaggtgatccgcccgcctcggcctcacaaagtgtgggattacaggcgtgagcaacagcacctggccccccctctcattttttaaacggttaaaatgaaggtgttagaccgtctctaaggttctatacaatcaaaaatttattaaaataggtctatatattttacaacaattttgactttctgaatcttgcatcatggtgtctagaacatatgtgttcaattaatactgaattaattaaaatttatatacactgatgtaaatattttctaagtaaaatctttcatatgtatttaaataaaatttacctttttgccttcaataactgattttcccatgtgcaataacgtgtgagtcagtgcccaaaagagtcacttgaaagttgcaaggcaaagcagttttttaaaaattatctaagattatcaaacaccggtccatgaacactgttgcattaattcagtgtcttaaaatggatttttaattatcagggatatctagagcaaagaaatctaacagggaaattttgaaagatgaaacaattttctatgaaatcagtgtattgtgtgcatcaatgtggtgcagtaacttagtaaggactcacagcgccgctgttcaccaaccagggaaaaatggtgcgagagatcccacagaaaccaccgagttttacagcacagagaaacgacagattgcgataagccctcttccaggctgcactaaactcaagcctctatcctgctggattctgagctccccttcctaagacagaggggtccacccggatacacccgcattctgaagcacttcccgagatcggcgcctaagcaagagaagcaggacgactatggcggctcagccgaggggcggggactacagaggattcttcctgctctccatcctcctggggaccccctgggaagcctgggcaggacgtattctctactccgtgtcggaggagacggacaaagggtcctttgtgggagacatcgccaaggacctggggctggagccccgggagctggcggagcgcggagtccgcatcatctccagaggtaggacgcagcttttcgccctgaaccagcgcagcggcagcttggtcactgcgggcaggatagaccgggaagagatctgcgctcagagtgcgcggtgtctggtaaactttaacatcctgatggaagataaaatgaatctttaccctatagacgtggaaataatagatattaatgacaacgttccaagattcttgacggaagaaataaatgtaaaaataatggagaatacagctcctggggttcggtttccgttaagcgaggctggggatccagatgtgggcacgaactccctccagagttaccagctcagccccaatcgccacttctccctggctgtgcaaagtggagacgatgaaactaagtacccggaactggtgctggagcgggtgctggaccgggaggaagagcgggttcaccacctggtcctcacagcctctgatggcggcgacccgccccgatccagcaccgcccacatccaggtgacagtggtggatgtgaatgaccacacgcctgtcttctctctgcctcagtaccaagtaactgtccccgagaatgtgccagtgggtacaagactgctcacggtacatgctatcgacctggacgagggagtcaatggggaagtgacatattcttttcggaaaataactcctaaacttccaaagatgtttcatctgaactcgcttacaggagaaatatcaactttagaaggattagattatgaagaaactgccttctatgaaatggaggttcaggctcaagatggtcctggtagtctgacaaaggcaaaagtactgatcacagttttagatgtaaatgataatgctccagaagtgactatgacgtctttaagtagctcaatccctgaagacacacctcttgggacagtcattgctcttttctacctacaagacagagattctggaaagaatggtgaggtgacctgcaccattccagaaaacctaccttttaaattagaaaaatcaatagataattattatagattggtcacaaccaaaaacttggaccgggaaacactctctttgtataacatcacactgaaagccacagatggtggaactcctcccttgtccagggaaactcacatattcatgcaggtggcagacaccaacgataacccacccaccttcccccactcatcctactcagtctacatcgctgagaacaaccccagaggggcctccattttcttagtgactgcacaggaccacgacagtgaggataatgcccagatcacttattccttggccgaagacaccatccagggggctccagtgtcctcctatgtctccataaactctgacactggagtcctgtacgcgctgcaatcctttgattatgagcagttgagagaactacaactaagagtgactgcacatgacagcggggacccgcctctcagcagcaacatgtcactgagcctgttcgtgctggaccagaatgacaacccgcccgagatcctgtacccggccctccccacagatggttctactggcatggagctggcaccccgctccgcagagcccggctacctggtgaccaaggtggtggcggtggacaaagattcaggccagaacgcctggctgtcatacctcctgcttaaggccagcgagccaggactctttgcggttgggctgtacacgggcgaggtgcgcacggctcgggccctgctggacagagatgccctcaagcagagcctcgtggtggccgtccaggaccacggtcagcctcctctgtcagccaccgtcacactcaccgtggctgtggctgacagcatccccgaagtcttggccgacctgggcagccttgagccctccgacggtccttacaactatgacctcacgttgtacctggtggtggcggtggccacagtctcctgcgtcttcctagccttcgtcctcgtactgctggcgctcaggctgcggcgctggcacaagtcacgcctgctgcaggcttcagaaggtggcttggcgaacgtgcccacctcgcactttgtgggcatggacggggtgcaggctttcctgcagacctattcccatgaggtctccctcaccgcggactctcggaagagtcacctgatcttcccccagcccaactatgtagacatgctcatcagccaggagagctgtgagaaaaatgattctttgctaacatccgtagattttcaggaatgtaaagaaaacctgccaagtattcaggtgagcccagcccttcctttatttccatgaggaatttatttgcatgatatttctctattattttgcaaaacaaatgttttgaaaatagggatttaaaaaactttatagaggtaaaaatgagtttaccagtttccttcagtggtgacactttaatatagaacacataggatatagtatttctttagtgaaagcctatggacaagattatgaatatgtggactatcacattttataatttccacctactttccaatctatgttccaacctactttcttaactcatatattttatacattggaatgaatcgagtctttcatattgcacaaggttagcaggaataaaacacacctcagctgtcttctcaggattctctttagcattcaaatatgtaaaaggttctgaaagatttcttccatgtgaagatttttttctgtggctgattctgcctccatgtacctcagcttggtggtcctaaaaaatcttgattgcttcttgacctatttacagtataatcatttattaatggggtggtagtagaaggttggatttatgcctaaagaatgaaatgtgtgtgtatcacacttcactaagatctatatcaaagacagacatcaagtctaatgccacactaaaggccatcggacaaaaccaataaaatatgtcaaataaaatgtcattttaagtgttgtaattggcatttgtgacataggcaattacatgttttaacagagaattccagtatgttgttttagtggtacagccagatgaagtgtgtctgtgggctatcaaagtgggagattggggatactggctttgtttcaactgtctcacgtactcaaaccttagaccatcttatgtacacagatcctagaccagtagttgattttatttattaggtctactgaaaaattcagttggaaataacccaatctgggattaactacttccatattcttttgtataacattttagtaaagctcagtatatcaagtgattgtcatccagaaggggtggatgacaaggtaatcttgattccagagacctttgagtattaattaaaaacacacttttagccaggtatggtgttgcaagctgtagcccacctgcatgggaggctgaggcaagaggacagcttgaacccaagaattggaggcccacctagataatataacaagactctgtctcttcaaaaaaagactctttttagactagtgttgtatttggtagtattttgcacatgatagactctgtacaatagtgtgggggatacattttttttttttgacatggagtctcgctctgtcacccaggctggatacattttacaagttctgcagtgttcacatttcagatgtacaatcacttggggtagaagacaatgttgctgacaccaacaatgttactgagggaagatcctatggcagaactacggttataaggtattttgtaaaagaaaatctcctgaccaaaatttattagatgcataaaattgtttttaagcaatggagagacataatcactaaactcagtgagctattgcaatcaaactttccagggattgtttccttcaattcagaggtcaccaaggaatgtaaaataagtgcagaggtaggaagcagtgcttcagtgcagcagatctcagtgactttgtgttttgaggctatgtattatccccctgataactttgaagatgaatgttgtatttcataaccagtaaaataattgtgtaatgaggagaggagtaggctactgcctgtgatcatcgaaatgagaatcacataatattcctgtaatgaaatcactgaaactattgggaagggggtgtatttgaagataagtataaattgcaccttctaaaaggcaattttggtattactgatactctccggaaaaagttgaaataaatcaacttggaggtacttagaaaagtggagaaaatgttaggaacaatgaaagaaagataaaatgtatccagtatatttctaatgagtaagtatggaaaattactgtactctgagacggtttaggccaagtctgtgttatggctatctttatatagatagtgcatgtttgaagattggggaaagcttatgtcaataaatgtttatgtacttaatctacatgatttgcctaaaaatcctcaaagttgggatgaaggcattcctaagagtacatttttagacgtcattaaatatacagacgtatccacgtagtttttgttctttcagttaggcacacaattataattattgcactggttaacttgaagcagcagaggctgtagtttcctagtgctgactctgggcgccgctgttggccaaagtggagagcttggcgctccagatctcctcgcgcagccgcagcgcgctttccagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcaggtgagtttagttctttgcttgcttttaatttccagatgaattttatttggcataaattatgttttgaaaaacattgtgaagatagttgaaaataatttttaaggtgtatcacagagttttgggtttattttggtggtgttactataaaattgaactctaatagtcataggttattgtttcatttgcttttaaacgacttggaaaagattgttcaaccattttaagccttccagtattttattcctattatcactcattcacttaagaagtagctacccgtccatactggtaattttgctattgtttgtgtgtgtgtgtgtgtgtgtgtgtgtgtgtgtgtgtgtgtgtgtgtgtatcccaaactagaacttcagaaaattatcaagaagtctaaagccttgttattagcttagcaaaagtaaaatatatctcagaatttttagggttatgtttagcatttgaacctgtaactaggctcttgtagatttcttcactttaaacctcttttctgagccctgtttctgtaccagtgcccttcaaaactttaatacttcttaccatccttcaaaacatgaacaaactttaaagatggatcttggtgggagatgagactggttactaaatattaagtatgtgagtcagtggtcacctgggctccatgcccatggagacatgaaatctaaagcctagaatgtccattgctcccccaaacaaaaaacaaaagcaaaaacattagatctgaattaaaatgtaattttaaactgttgaaagtgacttttgtaaaatatgtaagaacatatttcaatacaattccaattagctgtttcggttgtgcattgatgtgaagtggtgagaatgttgatattaagaaccaatgtttcaggtacacaagttctaaataagctgatcaattcaattaaagttattcagtcttggctggacacagtgcctcatgtctgaaatcccagcactttgggaggctggggcaggaggaccgcttgagccccgggggtttgaaactgcagtgagctatgatcatgccactgcactccagcctaggtggcagaactagaccctgtctctaaaaaaactattattaggccgggtgcggtggctcacgcctgtaatcccagcactttgggagactgaggtgggtggatcacctgaggtcaggagttcaagatcagcctggcaaacatggtgaaaccccgtctctactaaaaactacaaaaattagccaggcatggtggcatgcgcctgtggtcccagctactcgggaggctgaggcagaagaatcacttgaacccgggaggtggaggttgcagtgagcctcgatcctgtcactgcactccagcctgggcaacagggtgagactccgtctcaaaaaaaaaaaaaactaatattaatagtaaaaactcggtataggctatccattattgtattcctgcataccttcttgtagcatttgaataaagctaatacctgaattgattgttgtaaggtagaagtagatgacccaataaatgtttgttattaatgaaaaggacatttcctaaggattgtgtagtgttctactgtatggtgcatattcagtggagtgggagttaacttcatagtttgtgtaccatttggatgcacatttgagaggacaacatattattggcactttgcaattttaaaaactcggatgaaagttgccctggtaggaaagaaaatccttactctccctaaaaatgttggctagttgtttttattaatctgacaaatggactaaagaaggttgaccaatgtccacaaatttatgtaaatgaacttatgagcttcatttatccaattccaaagtcatttcagataggataataatgcaatccactagaatatccctttgtaccttgtattgcagaatagataagcatttccccaataactcttaagaatgaatttatgtactgtaaaagatatgacataagagaagtattttgagatatgaagaagagcaacgtagtagggtatatcatttcttagctacatcatatgggcagtatacttgaatgaatatttcctgaagtagaagagtaaagaaaaattatttttataaagaatgttaatatagtcaggaagaggagatgtttggggattggtataaaattgccacaactttacaaaatagttttaaatagtatagatttccctaatatgtgtaatataaaacactagaaatattggggagttggaaatcatagaaatgaacagaagaatgataaaattgtttccatagctaataaaaaatgaatttttgaaatcagtatagtatgaaggctctgagagcaagaactgtatcatattaattattatattgccagtgacaagggcaatacttagttctagctaagagttcaaggtatgtttgcagaatggtgaaagaatggaccaatgtatgcaggtttgtataaaaacccaacgtgatatttctaacaatttggaaaacagagaaagataccttaaagaagttgttataattttttattaagtatatggacgtaaaaacttggcttgttaagttaggcacacaaaaacaattactgcactggttaacttgaagccgcagaggctgtagtttcctagtgctgactctgggcgccgctgttggccaaagtgcagagcttggcgctccagatctcctcgcgcagccgcagcgcgctttccagggcagccccagctcagactccccagcgccggcctttacaccgcttcctcctcggaaaaagaatcgtttcctaaactggaactggaactaaagcccgttcggagatccaaaaatctacaatacagaggttatttgtaacctggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacaagatttatactagaagtagcagaagatgcagatattggcttaaactctctgcagaagtataaactctctcttaacccaagtttctcattaataattaaggagaaacaggatggtagtaaatacccggaactggcactggagaaaaccttagaccgggaacaacagagttaccatcgtttagtcctgactgccttggacggtggacatccacccctaagcggcaccactgagctccggatccaggtaaccgacgccaatgataatcccccggtattcaaccgagacgtgtacagagtcagccttcgggaaaacgtgccaccaggcaccactgtgttgcaagtgtcagccactgaccaagacgagggcatcaactcagaaattacttattccttctacagaaccgggcaaatctttagtctgaattcaaagagcggagaaattaccactcaaaagaaactggattttgaagagaccaaggaatattcaatggttgtagaagggagggatggtggtggactggttgcacaatgtacagttgaaattaatattcaagatgaaaatgacaatagcccagaagttacattccattctctacttgaaatgattctggaaaacgcggtgcctggaacactaattgctttgatcaaaatacatgaccaagattctggggaaaatggggaggttaattgtcaattacaaggcgaagtcccttttaagattatctcttcatccaaaaattcgtataagttggtaacagatggaaccctagaccgagagcaaaccccggagtacaatgtcaccatcacagccacagacaggggcaagccgcccctctcctccagcataagcgtcatcctacatatcagagacgtcaacgataacgctccggttttccaccaggcgtcctacttagtcagtgtacccgaaaacaaccctcctggggcctccatcgcgcaagtctgcgcctcggacctggacttggggttgaacggccaagtctcctactctatcatggccagcgacctagagcctctggcactggcctcttacgtgtccatgagcgcgcaaagtggggtggtgttcgcgcagcgcgcctttgactacgagcagctgcgcaccttcgaactcacactacaggcccgcgaccagggctcgcctgcgctcagcgcaaacgtgagcctgcgcgtgttggtgggcgaccgaaacgacaacgcaccgcgggtgctgtaccccgcgctgggtcccgacggctctgcgctcttcgatatggtgccgcgcgctgcagagcccggctacctggtgaccaaggtagtggccgtggacgcagactcaggacacaacgcctggctgtcctaccacgtgctgcaggctagcgagcccgggctcttcagcctggggctgcgcacaggagaggtgcgcacagcgcgtgccttgggcgacagggacgcggcccgccagcgcctgctggttgctgtgcgtgatggtggacagccgccactctccgccaccgccacgctgcacttggtctttgctgacagcttgcaggaggtgctgccggatatcactgaccgccctgtaccctctgacccccaggctgagctgcagttttacctagtggtggccttggccttgatctcagtgctcttcctcctggccgtgattctggccgttgccttgcgcctgcgacgctcctccagccctgccgcctggagctgcttccaacctggtctctgtgtcaagtctggacctgtggttccccccaactacagtcaggggactttgccttattcctacaacctatgtgttgcacatacaggaaagacggagtttaatttcctaaaatgtagtgagcaattgagttcaggacaagacatactttgtggtgattcatctggggccttatttccactttgtaattccagcgagtcgacttcccatcctgagttggtgagtttcatttatgtctattctttttcattacccacccaattttctgtatttacatgaaactatcgtacattttcaagtccaatgagttgtcttagggaagtcagagctgctcagaaagctgtcctaccattctttaagaggagcagtaaattgtgagtttttatgtcgcataaaagaagtagccttatagatttacaaagtagtgagagtttgctcttagcttcctctctagcaaaaacatttggtgcgtttttttgtcctctttctcaaagctaatgaattttacctattcgttgtctcattctttaacatgtttatattttattgtatgtagataaaccattaaatttaatgtatgtaatcatttaattcatcttttaaagcaaagaaactgctagtagatgtctttcttcactgatttcactggtagttttcatctctttcttatgttcctcatatatgctttcttattcctacctaatggatttatgattttttgaatctcctaaaattttattaaaaatactatatgttggctgggtgcagtggctcatgcctgtaatcccagcactttgggaggccgaggcggttggatcacatggtcaggagttcaagaccagcctgggcaatatggtgaaaacccgtctctactaaaaatacaaaaattagctgggtgtggtggcgggcgcctgtaatcccagctactcaggaggctaagacaggagaattgcttgaacctggcaggtggaggttgcggtgagccgagatcactccattgcattccagcctgggcaacaagagcaaaactccatctcaaaaaaaaggaaggagaaggagaggaagaagaagaaaaatactacatgttatgtgtatgagagagaaagagagagactgattcactgaacttagaaggtccaaatcatccaaataattttctaagtttatccaggttttcttggatgcaaaatccttttccacctctatataattaccagaagaaacttacaaaaaaaaggaaatgctattgcctgaatttctcttgctcggaatcctgacatattcttgaagaaggggaaaaagacaccggatttgtcttatcgtttggagctttaaatataaatgactggatgttttctcaacatccttgtaggatggaaggtgaatacaggattattccatttttaagacaaaaactactagtcttgtgtacatacaaagctcccattacatggtataagtcttttgcttggtttcccttagtatgtgattcagtaaatgggttccttacaaagtgctgagatttcttataataccacttacttttaacctttcagtagttttctttgttgtatattttgtgttctttttcccaaattattatataagtttaagtgatgcttagaataatgtttaagaccactttaaaattgcataatttattgatgaaggattaaaatagaaacttgcttttcagtgtatatgcatttgaatcattgaaacacagtctgtgcatgcattacatattcacattaaaaaactaagcatttttgaaatagcagaaaagtttaagcaattacaaaaatgtgaaaatttccaactttaatcctgttaatatttagcaatattaggcgagaacatctgtaactattgctgaattaatattacttttataatacaaaaatttaaaataaacgtttttccaggaattttatcatcaaaataaaccccagaaaataatttcaaagtggataatctatccttatatatgtattaatacaattatatattttacatttacaaatatataggtataaaaattaaaaatgaatgtacttccaaacaagattgcacataaaaattacttcagaaaattgttaagatacacagaaaaaattgaagcatcataaaaaggaaattataatagtttacatatctagaaatagagtgcaaagttctaccaagaataagaataaattaatattaagcaatggtttgtgattttataatacacttacagaaattttattccactttatttacaactcagatatctaaaaaatagattgcttttgaaatacaaatgcaagaaacaattggagaaatctaaaatcataattagaagagagtagtgttttctttatcagccatctgatataatgttacacatcagtgggtgtagtaacggcttaggactctgagcgccgctgttgatcaactctaagcgaaaatcaggactccatccggatttccagttctgcggctacacaaaacccggcagataccacaaacctgctcccaggctgcagcaaaactcagcctctttcttctaaggaaaagatcaccatactttgcagggtggaagaaagaacctgatgaagcagcgcgcacagagatccttttgagaaaattccaaagcgaggcagcaatggcagctccaaccaaatgccagctccgcggaagattagtcctgctatgctcgctcctggggatgctatgggaggccagggccagtcagattcgctactcagtgcctgaagagacagaaaagggctatattgtgggcaacatctccaaggacctggctctggagccccgggagctggcggagcgccgagtccgcatcgtctctagaggtaggacgcagcttttctctctgaacccgcgcagcggcaccttggtcaccgcgggtaggatagaccgggaggagctctgtgctcagagcccgcggtgtctggtgaactttaaagtcctggttgaagacagagtgaaactgtacggaatagaaatagaagtaactgatattaacgacagcgccccaaagttccaggccgaaagtctggaagtaaaaattaacgaaatcgcggttcctggagcacgttatccacttccagaagctattgatccggatgttggcgtgaactccctccagagctaccagctcagccccaatcaccacttctccctgaacgtgcagactggagacaatggagccataaacccagagctggtgctggagcgcgccctggacagggaggaggcaactgcccaccacctggtcctcacggcctcggatggcggcgagccgcgtcgctccagcacagtgcgcatccatgtgacagtgttggatacaaatgataatgccccggtttttgctcaacggatttaccgagttaaagtccttgagaacgtgcccccaggcacctggctgcttactgcaacagccagcgacctggatgagggaatcaacggaaaagtggcatacaaattctggaaaattaatgaaaaacaatctctgctattccagcttaatgaaaatactggggaaatatcaacagcaaaaagtctagattatgaagaatgttcattttatgaaatggaaatacaagctgaagatggtgggggattgaaagggtggacaaaagtgctcatttcggtggaagatgtaaatgacaatagacctgaagtgaccattacatctctgtttagcccagtgagagaagacgcacctcagggaacagtaattcttcttttcaatgctcatgaccgagactccgggaagaatggtcaagttgtctgttctatccaggagaatctatcttttacattagaaaattcagaagaagattattacagattgttgacggcccaaattcttgaccgagaaaaagcctcagaatataatatcacggtgactgcaacagacagaggaactccgcccctgtccacagaaattcacatcaccctgcaagtgactgacatcaatgataatccacctgctttctctcaagcctcctactcagtctacctcccggaaaacaacgccagaggtacttccatcttctccgtgattgcctatgaccctgatagcaatgagaattctagagttatttactccttggcagaggataccatccaagggtctcctctctccacctatgtctctattaactcagacactggtgtgctgtatgctctgtgctcctttgactatgagcagtttagagatttgcaaatgcaggtgacggcaagtgacagtggaagcccaccacttagcagcaatgtgtcattgagactgtttgttttggaccagaatgacaatgccccagaaatcctgtaccctgccctccccactgatggttctactggtgtggagctggcaccccgctctgcagagcctggctacctggtgaccaaggtggtggcagtggacagagactcaggccagaatgcttggctctcctaccgcctattcaaggccagtgagccagggctcttctcggtggggctgcacacaggtgaagtgcgcacagctcgggccctgctagatagagatgcgctcaaacagagccttgtggtggctgtacaggaccatggccagccccctctctcggccactgtcacgctcacagtagccatagctgacagcatcccagacatcctggctgacctgggcagtcttcagatccctgcagacctggaggcctcagaccttaccctctacctcgttgtggctgtggcagtcgtctcctgtgtcttcctcaccttcgttatcacgctgctggccctcaggctgaggcactggcactcctcgcatctgctgcgggctaccagtgatgggttggctggtgtgcccacctcacactttgtgggtgtagatggggttcgagctttcctacagacctattctcaggagttctccctcaccgctgactcaaggaagagtcacctgatcttcccccagcccaactatgcagacacactcatcagccagcagagctgtgagaaaaatgagcctttgtgcgtctctgttgattccaagtttcctatagaagacacccctttggttccggtgagttcattttttttctttctttcttttctttttttgttttttgttttgttttgtttttgagacagagtcttactctgttacccaggctggaatgcagtggtgtgatctcggctcattgcaacctccgcctcccaaattcaagcgattctcctgcctcagcctcccaagtagagtagctgggactagagtagagtagctgggactacaggcctcccaagtagaataactgggactacaggcacgtgccaccacgcccggctaattttttgtgtgtttttagtagagacggggtgtcaccatgttggccaggctggtcttgaattcctaacctcaagtgatccacccacctcagcctcccaaagcactgggattacaggcgtgagccactgcgcctggcccttaactttctattatagttagctttctctttaactgtctgtacttaaggtagtataagttgatatcagtgtgtttctcatcacttttcactgggcctaattgttgctccaacactgaaaggaggcatttattagttatatttgctgatataactttcatgttctcataataattaacctgctgtcaacgtaaaccatacttcatggggtagctctcagcctgcattgatgtgggctttttgggtagggttgcttcattggttgcagtggactcatatcataaaattcttactcctttttttttttttttaagagatgggggtgtcattctgttgtccagggtggaatgcagtggtgtgggtaaagcttactgcagtctcaatctcctgggcttatgcaatcctcccacctcagccttcacagtagctaggactgaggtgggagggctagcaagctatgttgcccagactggtctcaaacgatcttcctgcttcagtttcccaaagcactgggtgaggtgtgaaccacctcacccagcaaattcttactcctacgatcatttattcaggtcatactatgtttgtaagggtaaactgataaaaaggtaaatgtattcttcttagagaaacagctgaaagcccagatttattgcttctattcttccatttctatgacaggaaaacacctctttgaggttatatttttcagatcacaagtgtgtaaagtctgtttgtgtttacagatattttctgacgaagattcaaacttcagttatccacttccaaaccctagtaaaccaattttttccctttaatggtgaaagttgtcacatcttttattctcatatcttcaaaggtcttaatttcctaatgctttaatgttaaattatggagaatagtaggacattcttcttttctatagtatatgcttgctcaagagaagtttctaagactggacactgtgaaatgacaaaacaaggaattaaaaatatttctctcacttatatattatttctggctcaattctccaacttttgagtctagaaatgaacttgcatatcagatataatttaagaaaatattctcaggaactgctgggaagattctaaaactattttactgtttttagctataaggaagagaataatgtattatttaatgttattttaaacatagtgttgtttcaaatagtaaataacatttcacaagacatttgaaaataagctttgaagttgactcaaaattctatgctaaacatgtgatccatagatacactgatgactgctggcatttctgtggaaatgaagaattgttttatttgtttgtaattatttgggtttcagttgctttatttttaagaaaaaaaagctgaagtgtctgggaatcctttatgacatacagacattttaattatttcaaacacgttttcccccttaagtgggtagcaaaaaaaataaagcatacttcaggctcatatttttaaccatgcaacaagaaaattgttacaatttctgttctgaggagtagccttcatacttagtatttataaatattgaaatgtatgttaatttggggaaaacataacagatatccatgaaggcttgtatgtcatggtaggtagttactattcgataccacaaaaatgtctcttgcccttaaaaccagaacacgaggctcaccagacagatgactgaatggagtatggaaaatctttatttctgtttttcttaggctatgtaggacttaacttattgtgcattggtaacagattgtagaacataagctgaaagataaaattcttgaccttaatgtctcatcttaaaaagaagcattggttgacattctatatctcgtattacttaaaaataatgggggagcgcagtatatattaaacaaagattggctttgtggtgatcattgttgaaggtggggtgatggctatgtgaaggttcactatatatactccctactgttgtataagtttgaaattgtgcataatagatttatttaaaacacaaagcatagaaatatctactataatattatggtgagagcaaaatttgagggggatgtacacctgcattttcgaagaatatatacatttcggagaccgaattcaaaatgaaaaaccgggctgctgtcccgcacggagcctctgggcgccgctgtcggccagtgcagagcaagcgctgacgccggggatccgtcagcctctggcctgggattccctgcgcagccaacaacagaaagaagaaaaccagctcccacacagagcctcccggctgcgcagacctttcccagcacagcggattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtgctatttcctttgctgctgcctttgttctaccccaccctgagtgagccgatccgctactcgattccggaggagctggccaagggctcggtggtggggaacctcgctaaggatctagggctcagtgtcctggatgtgtcggctcgcaagctgcgagtgagcgcggagaagctgcacttcagcgtagacgcggagagcggggacttacttgtgaagaaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaatttgataaaaaggaaatacatttagaaattttcgaatctgcatccgctggtacacgactatcgcttgaccctgccacggatcctgatataaacataaactcaattaaagattataagataaactctaatccttatttttcattaatggttagagttaattccgatggtggcaaatacccagagttatctctggagaaactcctagaccgggaagaacagagatctcatagcttgatattgactgccttggacggaggggacccaccaagaagtgccaccgctcacatagaaatttctgtcaaggataccaatgataaccccccggttttcagcagagacgaatatagaattagtcttagtgaaaatctgccccctgggtcccctgtgttgcaagtgacagccactgaccaggatgagggggtcaatgctgagataaactactacttccgaagcactgcccagagcacaaaacatatgttctcattggatgagaaaacaggtatgattaagaataaccagtcatttgattttgaagatgtagaaaggtacaccatggaagtggaagcgaaggacggaggtggtctctctacccagtgtaaagtaatcatagaaatccttgatgaaaacgacaacagcccagaaataatcatcacttctctctctgatcagattttggagaattcacctccaggaatggttgttgccctcttcaaaacacgggatctggatttcggaggaaatggagaagtcaggtgtaatatagaaacagacattccattcaagatttattcttcttccaataactactacaaactggtgacagatggagccctggaccgagagcagacaccagaatacaatgtcaccatcgtagccactgacaggggcaagccgcctctttcttccagtagaagcatcaccttgtatgtcgctgacatcaacgacaacgccccagttttcgaccagacgtcctacgtggtccacgtggccgagaacaacccgccaggagcctccattgcgcaagtgagcgcctctgacccggatttggggctcaatggccacatctcctactctatagtggcgagtgacctagagcccctggcggtgtcgtcatacgtgtcagtgagcgcgcagagcggggtggtgttcgcgcagcgcgcctttgatcacgagcagctgcgcgccttcgcgctcacgctgcaggcccgcgaccacggctcgcccacgctcagcgccaacgtgagcctgcgcgtgttggtgggagaccgcaatgacaacgcaccgcgggtgctgtacccagctctgggtcctgacggctccgcgttcttcgatatggtacctcgctctgcagagcccggctacctagtgactaaggtggtagcggtggacgccgactcgggacacaacgcctggctgtcctaccacgtgctgcaggccagtgagcccggactcttcagcctggggctgcgcactggggaggtgcgcacggctcgagccttaggcgacagggacgcagcccgccagcgcctgctggtcgctgtgcgtgacggtggacagccgccactctctgccaccgccacgcttcatctggtcttcgcagacaacttgcaagagatactgccagacctcagcgaccgccctgtactctctgacccccaggctgaactgcagttttacctggtggtggccttggccttaatctcagtgctcttcctcctcgccgtgattctggccattgccttgcgcctgcgacgctctctcagccctgctacttgggactgcttccatcctggtctctgtgtcaagtctggacctgtagttccccccaactacagtgaggggactttgccttattcttataatctgtgcattgcacatacgggtacaaaagagtttaatttcctaaaatgcagtgtgcccctacattccaatgaagacatggtttgcagtgtttctcctggagccttaattccacctcatggtggggaggatttgacttcacatcctgagactctgacttcggtgagtttctcttttttgtgtgtgatttatctaatagtctactagtttctcatattttaggcatactactttattttcatatctagaatcatatgtttaaaatccatagctttttacaatattttctcaatgttttttcaattatagttttcactatgtatttggttcataagttgctctatctttttgtaaaataatgtcaccagactgaagatattttgtctttgtcttttttttttttttttttttttgagatggagtctcgcactgttgcctaggctggagtgcagtggcgtgatctctgctcactgcaacctccgccttctgggttcaagcgattctcctgcctcagcctcccaagtagctgggattactggtgcccctcaccacagctaaattttttgtatttttagtagacatggggtttcactatgtcgaccaggctgttcagaaactcctgtcctcgtgatcctcccaccttggcctctcaaagtgctgggattacaggcgtgagccacaatattttgtcaagttctgactatcgaacagaagcagtggtcttggcatctaagaaaacaaacaagtaacctatctattcaaatttgcgaagacttagtgaatttacgatatcttatttatatatttttaaagcctaaaaatattcagaagacaggcccagtggctcacacctataatcacagcactttgataggctgaatcggaaagtatcacttgagcccaagaattgagaccagcctgggcaatatagggagaccccccatctctactaaaacaacaacaacaaaaaaaaacattagcagagtgtggtagcattcccctgtggtcccagctacttgggaggctgagctgggtggattgcttggtcctgggaggtcaaggttgcagtgagccctgatcttgccactgcactccagcctgggcgacagagtgcgaccctgtctctaaaataaataaataaatatgcaggcagggccaagtgtgctgtaatcccagcactttgggaggtggaggtggagaatctcttgagcgcaggaatttgagaccagcctgggcaacacagggagactccatcgctacagaacatttaaaaattagcagggtgtggtggcacatgcctgtggtctcagctactctggtggctgtggtgggagaatcgcttgagcccaggaagtctaggctgcagtgagctgtctaggtgacagagtgagaccctgtctcaaaaaaaaaagacatttctaagaaataaatgaaatactattgcctttgcactcagtctctgtctctgattctctgatagaagatttttgaagaaaaaagataaaatctttgaagagttctatacttggaaggcatagtgacataaacacttctgaacatcctgttctctgtgtgaaagaagtgaacttctataccctttgcatttgagggaacaattgctactgggttgatgggcacacacagttgaagatatgtgaaccactggactttggcctctgatacaaactgcctaagagaagagattatttatactggtattaatgctctgatgaaaacaggtcatttgacataaacacttacttgttaaaaacctatatcactacatctaactttgttttctaaaacttttagtacttcaaattctacgtatttcttttctcattacaatgcaaacagtttaatttgcaactgtaatatatgttcattttagtttgtgattacctgcttaatcatttaaataggtccatttaacttgtatccctgtaagataaagtatgttttacacaaaaaggttaattaaggctcagtaaaactattctagaagagtactttaaaaacctcttacacaatcctaagctaaataagtttaatgaattaagtagttacaattataaagcttcagagtgaattatctcatgagtttatttaatataatctttgtatgaatgtatactaaataaaattggcctattcaaatcacaattttaaattataagacttttctgaatttacctagacactaatatgacctaaaataagtattatttaccttttattaaagtgtgtacatttctgttgggaaaacgtgttgcaaatatatatttaaccaaacattatcttgaaatatttacaatattttcactccactttatcacacctcccctaagaaacctacatatagtaaattatttaaagataggagtggagaaaccaaagaatctatgtaaaatataataatccaacagaatagtttactttccattgcatgtatcacttgggtgcagtaacttcttaggactctgagcgccgctgttcacctactaggagagaaaacgcagccagagctcaatccggattctcagggcttcaactacacaagccccacaaaccggctgctgggctgcagggaagctcactccagaatttaaagtgcccaggctacagagacaccctgaagccacagaaagacaaaggaaccggttgaaacacacaacgtgtccagtgaggactttgcagaattctgtaaccagactacaatggccgctcaaaggaatcgctcaaaggaatcaaaggattgcagcgggctggtcctgctctgccttttcttcgggattccatgggaggctggagcccggcagatctcctactcaattcctgaggaattagagaaaggctctttcgtgggcaacatctccaaggacttgggtctggcgccccgggagctggcggagcgcggagtccgcatagtctccagaggtaggacgcagcttttctctctgaacccgcgcagcggcagcttgatcaccgcgggcaggatagaccgggaggagctctgcgctcagagcgcgcggtgcgtggtgagttttaatatccttgtggaagacagggtgaaactttttgggatagaaatagaagtaactgatatcaatgacaatgctccaaaattccaagcagaaaatctagacgtaaaaattaatgaaaatgtcgctgcgggaatgcgttttcctctcccggaagctattgatccggatgtgggcgtgaactccctgcagagctatcagctcagccccaataagcacttctccctaagagttcagagccgtgccaatggcgtcaagtacccggagctggtactggagcactccctagatcgcgaggaagaggccattcaccacctggtcctcaccgcctccgacgggggtgaccctctccgatctggcactgtccttgtcagtgtgactgtcttcgatgcaaatgacaacgcgccggtcttcaccttgccagaataccgagtgagtgttcctgagaatttgcctgtgggcactcagctgctgacagtcacagccaccgacagggacgaaggtgccaatggagaagtgacatattcattccgaaaattacctgacacgcaattgttgaagttccaactaaacaaatatactggagaaataaaaatatcagaaaatctagattatgaagaaaccggtttctatgaaatagaaatacaagcagaagatggaggagcatatcttgcaactgcaaaagtgttgattacagtagaagatgtaaatgacaacagtccagagctgaccatcacgtctctatttagtccagtgactgaagattcacctctgggaacagtcgtagcccttttaaatgtgcatgatttagactctgagcagaatggacaggtaacctgttccattttggcgtatctaccatttaaattagaaaagtccattgacagttattacagattggtgatacacagagcccttgacagggaacaggtatcctcttacaatatcacagtgacagccacagatgggggaagtcctcctctatcaacggaagctcactttatgctacaagtggcagatatcaatgacaacccacctaccttctctcaagtctcctactttacctatatcccagagaacaacgccaggggtgcctccatcttctcagtgacagcgctggacccggacagcaaagagaatgcccagattatttactccctggctgaagacaccatccagggggtacctctgtcctcatacatatccatcaactcagacactggcgtcctgtatgcactcagatccttcgactatgagcagtttcatgagctacagatgcaggtgacagccagcgacagcggggatcctccactcagcagcaacgtgtcgttgagcctgtttgtgctggaccagaacgacaatgcgcccgagatcctgtaccccgccctccccacagacggttccacaggcgtggagctggcgccccgctccgcagagcccggctacctggtgaccaaggtggtggcggtggacagagactccggccagaacgcctggctgtcctaccgtctgctcaaggccagcgagccgggactcttcgcggtgggggagcacacgggcgaggtgcgcacggcgcgagccctgctggacagagacgcgctcaagcaaagcctcgtagtggccgtccaggaccacggccagccccctctctccgccactgtcacgctcaccgtggccgtggccgacagcatcccccaagtcctggcggacctcggcagcttcgagtctccagctaactctgaaacctcagacctcactctgtacctggtggtagcggtggccgcggtctcctgcgtcttcctggccttcgtcatcgtgctgctggcgcacaggctgcggcgctggcacaagtcacgcctgctgcaggcttcaggaggcggcttgacaggtgtgtccggctcgcactttgtgggcgtggacggggttcgggctttcctgcagacctattcccacgaggtctctctcaccgcggactcgcgaaagagtcacctgatcttcccccagcccaattatgcggacacgctcatcagccaggagagctgtgagaaaaacgatcctttgtctttgttagatgattcgaagtttcctatagaggataccccattggttccagtgagttttattttcatttttacttttgttaaaaaaaaaaagattggtttttactttgaagtttgcggcatgatggtggaaagtgtaaatgctaaaacactgatgagtagaatttgatgtttattaaggttttttttttttttttttttttttttttttttactttctggtaaaattcacctagtctcaatcaaggcctatatatcataaggctttgttatgattagctttgcagaaccttgtagtttatagtgttgttgagtacaatattgacaattcctaagacagacttccatacagaagtgcctgtcaatttatatttcctcctgggtggtcacatattgaaactccagccccttaagcaaccctcttgttctgaaggcaggtctggtaagaataggtaagtatcagaaagaaatcacctctggaaacacaacccaaatccaagaatactcaatgcagttcttcccaaggagaagggcaataggcctttttcaaactacattttatatatttttcaatctatactttgtggtgatagttgcagttgaatatactaagtttttcattaatattgaattaacaatttatttataacaatgtatgcttagatttttccagccctatttataactgataacactgcagtatcctttttgcatacaattctctaatttcacactgctatgtggaagatatagcattttaatttaactttcattgctcaatagggatcctgaggaggctatagagggtgaaattaagaatatttgggattctgcttttgtcttttttgttaaattttctagtgactaaggctgaaagtaaatatgggttgggaagacagataaatttgtacatgttcccgagaacaggagcaagagatatatgacaaagctatttcagtggctctttaatgtataaggaggcaaacacctgaaactctgaaaactctgaaattgagaggcaaaataaacttagagtcaagaaagaaatgccatttctgcagatcagaatataaacaccaaccacagctgtaaaaaagaaaagaatatatgcaacgaagggaaattatataaacaaaggatcattggaggtactgatgagttcatttagttcaatgaaaatagtgacgtattaggtagatctcttaattttattactagtattctactaaatgtggtagtataaagtcaaaaagcattccgaagtttctcaagacccttataattccatgatttttttcaggtcagtcaacatttgttgaatgataggtctgtggaaggaaagcacactctttagggtcatagttattaactattaaaccattgaaactattattttatatttgtgttaatgagagtcaaaattattgtgcattcatctcaaataattctattattttgaaaaatacaggttttttttttaaaaaaaactgctcttgacattgtagctattgtgagaaaatattttgattataattatttaaaagcaatacaggacaccctggatgatggtaatgactagggcaatggttgcattccagtacttaagtatgaaataaggaattattactttctgggtgaatataggctagaattgaagacaaaaaaatttgttgcttatcttcagtacttccagcttcatagataattactcttaaaaggaacaagaatgactgcctctggatggaggaattggatagcaatgggccgtgggataggagacctataaaccttcatgctatattattttgtgcctttttaaattttgaagaaaaaatattcatttattcaagatatatgtaaattcagtaaataaaaagatatgatagttatgaccaagtggaaatatatttcctgatgtaaaaggaatcactgaggaaaaagattaaaatattttggctgtcaactcgtagtttaaaaaaaattccttgaaagaggtagagaaaagtcaagttgcagtcccacacagagcctctgggcgccgccgtcggccagtgcagagcaagcgctgacgccggggatccctcagcctctagcctgggattccctgcgcagccaacaacagaaaagaaaaccagctcccacacagaggctcccggctgcgcagaccttgcccagcacaccagattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggagaagctgcacttcagcgtagacgcgcagagcggggacttacttgtgaaggaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaattccggaaagatgaaataaacttagaaatcagtgaatccgtcagcctggggatgggaacaattcttgagtctgcagaagatcctgatattagtatgaattcgctgagcaaataccaactaagtcctaacgagtatttctcattggtggagaaagacaatcctgatggtggcaaatatccagaattagtattgcagaagactctggaccgagaaacgcagagcgctcaccacttggtactgaccgccttagatggtggggaccctccccgaagcggtactgctcagataagaatcctggtaatagatgccaatgacaaccccccagtgttcagccaggacgtgtacagggttagccttcgggaagacgtgcctccaggcacctccatcctgagagtgaaggccactgaccaggacgagggcatcaactcagagatcacttattccttctttggtgtggctgacaaagctcagcacgtgttctctctggattacactacaggaaacattctaactcagcagcctttggattttgaagaagtagaaagatatacgataaacatagaagcaaaagaccgaggatctctctcaacacggtgtaaagtaattgtagaagttgtagacgaaaacgacaacagcccagaaataatcatcacgtcactctctgatcagattatggaggattcccctccaggagtggttgttgccctcttcaaaacacgggaccaagactcaggggaaaatggggaagtcaggtgtagcttaagtagaggtgttccatttaagattcattcttcttctaataattactacaagctagtaacagatgaggccctggatcgggagcagaccccagagtacaacgtcaccatcgcagccacagacaggggcaagcctccgttatcctccagcaaaaccataaccctgcacattactgacgtcaatgacaacgcgccggttttcggacagtcagcctacctggtccacgtgccagaaaacaaccagccgggtgcctccatagcgcaagtcagtgcctctgacccagacttcgggctcaacggccgtgtctcctactctctcattgccagcgacctggagtcacgaacgctgtcgtcctacgtgtccgtgagcgcgcagagcggggtggtgttcgcgcagcgcgccttcgaccacgagcagctgcgcaccttcgagctcacgctgcaggcccgcgaccagggctcgcccgcgctcagcgccaatgtgagcctgcgcgtgttggtgggcgaccgtaacgacaacgcaccgcgggtgctgtaccctgcgctgggtcccgacggctccgcgctcttcgacacagtgccgcgggccgcgcagccaggctacctggtgaccaaggtggtggccgtggacgcggactcggggcacaatgcctggctgtcctaccacgtggtgcaggccagtgagcccgggctcttcagcctggggctgcgaacaggcgaggtgcgcatggtgcgtgctttgggtgacaaggactcggtccgccagcgcctgctagtcgctgtaagagatggaggacagccacccctttcagccactgccacgctgcacctggtgttcgcagatagcttgcaagaggtactgccggatttcagcgaccatcccacaccctctgactcccaggctgagatgcagttttacctggtggtggccttggccttgatttctgtgctctttctcctcgcggtgattctagctattgctctacgcctgcgacagtctttcagccctactgcaggagactgctttgagtcagttctctgctccaagtccggacctgtgggtccccccaactacagtgagggaacgttgccctatgcctataatttttgtgtgcctggggatcaaatgaatccagaatttaattttttcacatctgttgatcattgtccagccacacaagataacctcaacaaagatagcatgctactggctagcattttaactcccagcgttgaagcagataagaagattcttaaacaggtaagtatttaaaaatgtatttaatcctttttatattacaatatgccaatatattccaatatagtggtattattttaagattctagataacttcttcatagagttcgcaaaatataggtcaaatttatggttatcattattaaaacaaaagtttaaattaaatgcctcagtcttcctactattcaaagacattttaaagcaaactacatgggtaatctccggtgacatttttatgaagtaaaatacctttcggttaaaaatataaaatacaggtatatttttacggcatggtattttaattgaaaccctgatgctactcaatttttctcaagtatttcatcttcatttactcaataaaggaaccttgtaagaattatagttaggcatcctacctgatgattttatcgggaccgtattatttccacttccagaaatgtcgttcctttcagtcggttaaaatcaattggaaccaactacaacctacaagttttcagctccagtaatattttgaaaactttttaaaaattaagcaagcccttttaataattactcctttcgcaggtgttcttggtaaagttttaacgtcacataatgtaagtattgtgtatcatcgtttttaagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgaggtgcgtacagcgcgggcactgctggacagagacgcgctcaagcagagcctcgtggtggccgtccaggaccacggccagccccctctctcggccaccgtcacgctcaccgtggctgtggccgacagcatccccgaagtcctggcggacctcggcagcctcgagtctctggctaactctgaaacctcagacctctcgctgtacttggtggtggcggtggccgcagtctcctgcatcttcctggtctttgtcatcgtgctgctggcactcaggctgtggcgctggcataagtcacgcctgctgcaggcttctgaaggcgggttggcaggtatgcccacgtcacattttgtaggcgtggacggggtacaggctttcctgcaaacctattcccacgaggtctctctcattgcggactcgcagaagagtcacctgattttcccccagcccaactatggggacacgctcatcagccaggagagctgtgagaaaagcgagccactcttgatagctgaagactcagctatcattttaggcaaatgtgacccgacaagtaatcaggtgagatttatttctctgcctcctaattgttggtgtcttggcacaagtcttttaaggagatgttttttgagcctgttatgaaaactgtttggggggggggtggggcggcatatatttagttcatatatatttagagcaatacatgtgagttttactttgcctttcatgagattacgataatctttcagaacgtttttgtgaaagtcatttttcaatcttggcatattttcttttgatttcaaaggggccattcaactatgctggtttggtttgaagtaagttgaattttagtattatttttctattatcagtgtatgaggctctcaatttattatatatagatacaaattaatgattcacaaacactttttatttccatttcaattttgctgtgccttcactgatttgtagttatattccaccattatttgctattactgctaatgttcaaattttgatcctgttgatttaatagcatgctccctctagctctccttctcatctatctatctatacacatgcacacacacttatacacgtaagcttttctctgagcaattttattttgattcttggtggctggtaatatgcttagatcctgttgactatttcaactttgtctcatttcttcatcctatcaacacagacatattgactggcttttaactactggatttccttgggagataaaatttagatcacattttttcttaagctctagatgtcttttccattactatggtgaagttacattgactgttctgaggaaataattgaattattgaactggtattatttccttttattcttttactttggtgtctgtgtttgtatgtatggaaggttttttaatgtagtaaatccatatatagaaataacttgattttgattcagtgcttctcaaaaacctattttcaaatgtgctaaagatgtctacagatttattcaaatagagtagtttgtgaatatataaatagattgaaggtatttggactttaattaaactgatttagctagtatccttctggctatttttttgttcattttcagtgtagttgggagtcatagattccttctttctttctttataaggtcattcttatggcaaatagtacattcagttcttttattcagaccaacttgttattgaagcttgatagttgcctgacatacatgttatctgaagcaatgtctaggaaagccaaatgaggaaaggagacttatctagggtttttgatcacaggaatcatttccataatcaattcagtcaacactctcacatcacttctaggtatttgccccaaattacttggatatttatgttccctttcaagtttagttttctcatttaggaatttaccttatgtcattagttgtaaactgactatctagggctcggacaaaaataatttcaactgtaggaaaggcaagtcttccaacagatgcctacatttttcttgaagtcaagaaaaatgttcaggtattttgagcatctagggataggatttatacttgtggaattccaaactgagaaaaatgatgtaaggcattgtactttgactggaattagttaaataaaaaggatatgaggtatttggctgggaaaaggagattgttccatattataaaacctcatctaaactaacttcccaagatcgtggagaacaaaaaggaagggttggctttgaaatgtgatattaagagggttatgttgattcggaggtagtgataaagttctgttaaggtataacatatagtcccattaaatagaggataaaaataaaacaccatcacatttcatgttattaattcctatggcaacctactaggctatacctttatattctctttatgatgaaacatgaaacaataatccttttcagaaacctcttttataagtgataagaagggtttggctaactttattctgaatatgccctatatagctttcagtgctcctccagttttctctgataaaactaggaggaaaattatctgcacatcagattgaaaataatactgcatatcatttcatagtggtcaaaattttcccataccacttgatggggatgttttcccacaaggtttttgttctacaacaggagagaagactttgcctagttcttccaatatgtgcattgcttctgcttagaaaaaaacaaacttttaaattctctttgctgggttaatgactgttctatagattcccatctctaaggaatcttctttggtagtaaacactggaaaacagtcactacgaaaactcataaaatgtctagtttcctatacattagtccaacacatcagtctaattctgaatcccattgaattagcaaaggcttccggctgcagttttctaaatagactcagagccctgctgttggccaatgtgctgcaagaactggagcctgggatctaccaggacgatattctgttcagtcacagaagcaagtcggagagtggccaagacttgggctttctgctcctgcaaatctgattccatacggattggggtgccctcaaactgggagcattgagttttctatgtatggaagtaaatattttaaaagcactttgtgaaacattttctcttaacgtcggagactgcagcaacgcatgggaaggatgggaaacagggtgaagcagagaagcaggacccggcagtggcaagcactcttccctttcctgctgcctttgttctgcggggcaccctcggagcagatccgctactctattccagaagaaacggtccagggctccgtggtggggaaccttgcggaggacatgcggctgcatgttcaggatttattgacctgaaaccttagagttagtgcagagaaacaatactttaccgtgaacacggagaatgggaacatacttgtgagtgacagaatagatcgagagtcactgtcttcaaaatcctctgtgtcatacccttagagattgtagcagagaatcctctaaatgtttttcacataaatgtgatgatagaagatataaatgataacccacctcattttccccaaaatagcattgttttacaaatcaatgaactagcaattccaggcattcggtttggcctggaatctgctatagatgcagatgtagggcctcactctctccagagttaccagctcagttctaatgaacatttctctctgatgatggacaagactaaaggcaagaacgctccagaattagtgctggagaagcccctgggccaggagcaacagagctctcatctcctggtcctggaagcaatggacatgggtgacccagtcccaactggcactgctgcaattcaaattgaggtcactgatgccaacgataatgccccagtttttagccaggatgtatacaaagtcagccttagagagaatgtgcccccaggcacctctgtactaaaggtgacagccactgaccaggatgagggtgtcaatgcggagatcacctactctttcaaatccctacgagatgatattggaaatatgtttgtgctagaccatcaaaatggggaaattaaatccaaagacttaatagacttcgaatttcgtagcagttataccatgagagtagaagctaaggatggtggaggcatgaccagcgaatgtaaaattatactagaaatcctagatgagaatgacaatgccccagacgtggtttttacttcagtgtccagttctgtaactgaggacgcagaaccctggacggtgatcactctgttcaaaacacatgataaagattcgagagaaaatggggaggttacatgcctcataaacgaaagagttccttttagaatcgaatcttccgccaataatgactataagcttgtaacagatgggaccctggattgggagcggatcccggagtacaacgtcaccatcactgccactgacaagggcaagcctccgctctcatccagcacaagcctcaccctacgcattggtgaagtcaacgacaatgctccggttttccaccaagtctcctacgtggtccacgtggccgaaaacaaccttcccggagcctccatcccacaagtcagcgcctctgacctggacctagggctgaatggccaagtctcctactccatcgttaccactgacttggagctgcgggcactgtcgtcctacgtgtccgtgagcgcacagagcggggtggtggtcgcgcagcgtgccttcgaccacgagcagctgtgcgccttcgagctcacgatgcaggcccacgaccagggctcgcccgcgctcagcgccaacatgagccggcgcatgttggtgggcgacctcaatgacaatgtgccgcgggtgctgtaccccgcgctggggcccgatggctccgcactcttcgatatagtgccacgcgccgcagagtccggctacctggtgaccaaggtggtggcggtggacgcagattcgggacacaacgcttggctgtcctaccacgtgctgcaggccatcgagcccgggcttttcagcctggggctgcacacgggaacctgctggttgctgtgcgtgacggaggacagccgccgctctctgcgccgctacgcttcacctagtcttcgcagacagcctgcaggaggcactgccagacttcagtgacagtcctgtgccctctgattcccaagcaaagctgcagatttacctggtcgtggccttggccttgatttctatgctcttcttcctcgcagtgattttggcggtcgccttgcacctgcgatgctcttccagcccctctgcctggggttgctttcaccctggtctctgttctaagactagaccaggggtttttcccaactacaatgagggaactttgctttattcctgcaatctgtatgttccctcggattctagaaaaagaagatttaattttctcaccatgacaccagaaacagtccccccacaagatctttctaatgaagtttctctggtagcaagcttcactgaagagaataacaagataagctctaactctgttgctcctactcacgtgagttccaatgaatgtctttcatttacaaatggatgaggtttaattttcaaaccaatattttggcaagaaaatcttaaacatattatatctactattgcttcaggtttgtttgcccactcttaatatttcctgttcctttctgtgtgggccagtaacttcattattagctttcatgtatttttgaaacattttcaccatttttacgggagactttttttttttttggacggagtctcgctctgtggtccaggctggagtgcagtggcatgatctcggctcactgcaagctctgccttccgggttctggccattctcccgcctcagcctcccgggtagctgggactacaggcgcccgccaccacgcccggctaattttttgcatttttagtacagacggggtttcaccgtgttagccaggatggtctcgatttcctgacctcgtgatctgcccgcctcggcctcccaaagtgctgggattataggcgtgagccactgcacccggcccggagacattgtttatacacacacacacacacacacacacacacacacacacgtgtgaaaagtgggtattatgatactgctgtcattgagatattttaattgaggaataaatttttttcctgtgatgtttcttgggacatcaatatttgagtatataaggctttttctttaatccattaactataaattttgaagaaaatgcatgagaaaatggagaaaatgtgttttttttttaaaaaaaattgagattaaggtctcattatgttgcccaggctggactcaaactcttgggctacagtaatcctcccacctcaatctccagagtagctgagactacagttgcctgaaactgtgcctggcagagaaaaaagcttaaaaaaataagaacatggtaatgatttgataatattcagttacatttacttttgattcttgtaattcaagtaaactcaattttatgtctgatattttctcacagctacctatatatttcttcccaatttaaaatatattattttattttatgcctagcaaatatctttacagtataaatatttacgctcatgaaagtacgtagccagttatttcttagggagaattttttccctatattttgatgggcttccaaaagtattaccagtaattctcagtaattacaattaggtcagttacccaggaaaaggtaagtctgtaacattctttggactaccaattttcttttactaagtttcctgaacaataaatatttttgaaatataatgtattaatagaattctggagtacttccattatttccagtcaatgcaagttggaatgcttctactttatgctaaaaatattaatgtttctttttcacttgggttcttgttaagtgtgattctgataatgtatacaatcacatatcatttttaggtttccataatatcatgaaaatttgatttttaagcgttacatgtcaacaacctggtaaagtaatccttccattcaggatcattcaaggaatctatttaaaaatattttccccaaattatagctgaatcagaaagtttaaattattatattatatgatttgtcaaaaagagaaactcctagggagacatctccataataggtgtgttgggggaacagtaatctcaaagcagatgcactaacattataagattaaaatcattgtttatagaaacttccaattcatttaaaagctcattggggaaaaaaaagctcattgggaaaaaaaaaaaaagctcactaaagtttctattaaagcgaatacggtagatttccatccccttttgaagaacagtaggtggagctatttaagatataaaaacgaaatatcctttctgggagttcaagattgtgcagtaattggttaggactctgagcgccgctgttcaccaatcggggagagaaaagcggagatcctgctcgccttgcacgcgcctgaagcacaaagcagatagctaggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgactgcaccgggactacaaagggcttgtcctgctgggaatcctcctggggactctgtgggagaccggatgcacccagatacgctattcagttccggaagagctggagaaaggctctagggtgggcgacatctccagggacctggggctggagccccgggagctcgcggagcgcggagtccgcatcatccccagaggtaggacgcagcttttcgccctgaatccgcgcagcggcagcttggtcacggcgggcaggatagaccgggaggagctctgtatgggggccatcaagtgtcaattaaatctagacattctgatggaggataaagtgaaaatatatggagtagaagtagaagtaagggacattaacgacaatgcgccttactttcgtgaaagtgaattagaaataaaaattagtgaaaatgcagccactgagatgcggttccctctaccccacgcctgggatccggatatcgggaagaactctctgcagagctacgagctcagcccgaacactcacttctccctcatcgtgcaaaatggagccgacggtagtaagtaccccgaattggtgctgaaacgcgccctggaccgcgaagaaaaggctgctcaccacctggtccttacggcctccgacgggggcgacccggtgcgcacaggcaccgcgcgcatccgcgtgatggttctggatgcgaacgacaacgcaccagcgtttgctcagcccgagtaccgcgcgagcgttccggagaatctggccttgggcacgcagctgcttgtagtcaacgctaccgaccctgacgaaggagtcaatgcggaagtgaggtattccttccggtatgtggacgacaaggcggcccaagttttcaaactagattgtaattcagggacaatatcaacaataggggagttggaccacgaggagtcaggattctaccagatggaagtgcaagcaatggataatgcaggatattctgcgcgagccaaagtcctgatcactgttctggacgtgaacgacaatgccccagaagtggtcctcacctctctcgccagctcggttcccgaaaactctcccagagggacattaattgcccttttaaatgtaaatgaccaagattctgaggaaaacggacaggtgatctgtttcatccaaggaaatctgccctttaaattagaaaaatcttacggaaattactatagtttagtcacagacatagtcttggatagggaacaggttcctagctacaacatcacagtgaccgccactgaccggggaaccccgcccctatccacggaaactcatatctcgctgaacgtggcagacaccaacgacaacccgccggtcttccctcaggcctcctattccgcttatatcccagagaacaatcccagaggagtttccctcgtctctgtgaccgcccacgaccccgactgtgaagagaacgcccagatcacttattccctggctgagaacaccatccaaggggcaagcctatcgtcctacgtgtccatcaactccgacactggggtactgtatgcgctgagctccttcgactacgagcagttccgagacttgcaagtgaaagtgatggcgcgggacaacgggcacccgcccctcagcagcaacgtgtcgttgagcctgttcgtgctggaccagaacgacaatgcgcccgagatcctgtaccccgccctccccacggacggttccactggcgtggagctggctccccgctccgcagagcccggctacctggtgaccaaggtggtggcggtggacagagactccggccagaacgcctggctgtcctaccgtctgctcaaggccagcgagccgggactcttctcggtgggtctgcacacgggcgaggtgcgcacggcgcgagccctgctggacagagacgcgctcaagcagagcctcgtagtggccgtccaggaccacggccagccccctctctccgccactgtcacgctcaccgtggccgtggccgacagcatcccccaagtcctggcggacctcggcagcctcgagtctccagctaactctgaaacctcagacctcactctgtacctggtggtagcggtggccgcggtctcctgcgtcttcctggccttcgtcatcttgctgctggcgctcaggctgcggcgctggcacaagtcacgcctgctgcaggcttcaggaggcggcttgacaggagcgccggcgtcgcactttgtgggcgtggacggggtgcaggctttcctgcagacctattcccacgaggtttccctcaccacggactcgcggaagagtcacctgatcttcccccagcccaactatgcagacatgctcgtcagccaggagagctttgaaaaaagcgagccccttttgctgtcaggtgattcggtattttctaaagacagtcatgggttaattgaggtgagtttatatcaaatcttctttcttttttttttttaattgctctgtctcccaagctggaatgcagcggtacgatcatagctcactgcagcctcaaactcctaggctcaagcaattatcccacctttgcctccggtgtaacagggactacaggtgcaagccacctactgtctgcctatctatctatctatctatctatctatctatctatctatctatctattactttcttgtacagacaggagtctcactatgttgagcaggctgatctgaaacttgggctcaggctagcctcctgcttctccctcccaaactgctgggattacaggcgtgaaccacagtgccccgcccttatcagatattcttttctggctgggcgcggtggctcacgcctgtaatcccagtactttgggaggccgaggcgggtggatcacctgaggttgggagtttgagaccagcctgaccaacatggagaaaccccgtctatactaaaaaaatacaaaattagccgggcgtggtggtgcatgtctgtaatcccagctacttgggaggctgagtcaggagaattgctttaacctgggaggtggaggttgcaatgagctgagattgtgccattgcactccagcctgggcaacaagagtgaaactctatctcaaaaaaaaaaaaaaaaaactttatcctctagtttcatccattgatgacacttgctttaatcacttattacaatcacctccaaatgaagattttataattccattgtttcttctacagttgttaattggctttctaccttgaagaagagttttatattctctatatatgtttgtttctatgattctggaagcatggttttctattttattcaatggcctgtaatctgttaatatcaattatttattttgatgctgaaattgtcccaggattggcctttgggactccctttaggctgatttctatgtcctttctgttacagcaagcttgggattatatccaagatttgtaattccaatgtacttacttctgtcagtgtaaacaaagtacgatttctggactagatgacttgggcattgtgggggaggtggaaattagaggtattctctgtttttcctgtaggatcttgcatttcttcctcttgctgcttgtctctttgtgtcgggaacaggccccccaaaatctggccataaactggccccaaaactggccataaacaaaatctctgcagcactgtgacatgttcatgatggccgtaatgcccatgctggaaggtagtgggtttaccggaatgagggcaaggaacacctggcccgcccagggcagaaaactgcttaaaggtgttcttaaaccacaaacaatagcatgagtgatctgtgccttaaggacatgcccctgctgcagataactacctcaatccatccctttatttccgcccatctcttcgtttcccataagggatacttttagttaatctaatatctatagaaatgatgctaatgactggcttgctgttaataaatatgtgggtaaatctctgttcagggctctcagctctgaaggctatgagacccctgattccccacttcacacttctaaaaaaaaaaaaatttttttttctgagcttggagaaatatatcccttagtacacttggcatttataaagcagacatcaataaatttatatatatgtgacagataccaacaacaatccagtccccttccctcataccttatttatgtacatatattttatataatagatataatttattaacaatttataaaattactttgttaatactctatatcattttctagctgaatttatcaatgataatgctcttttcccacttttatttttttcccattgaccatgcagcagttttgtgtagaccgtctgataacaactgatctgtttatctaggggggagaaatctaattcaatggaaaatataaataaaattgtgataaacttttgtaaatagagtggcttttaactacacttgagatggctagcaaattcataaagtgaatttactttctttcaaagttcagtaattctttctggccattagggatatgtccatttatactttctcagtatcccaagtcatttcatggttttaaatcattcatgaacttccaaatatagtgaatttatttcttctgcatttaaaattttatcacttaaatatacaatataccgtattgccatgacgaaaaatggtaaagactatttttcacttctgttatgcatttcattaatacgatatctgtatgtgtttccaagttagacatttcttttgcccatttcctacactaatgatactaatgatgactttgtggaatattcagaattaacaaaatgtgttttgagtgctttttttagtactggggcaaatttgcagtaatatcgcctgctttttacattaaattccccataacttttacaactatgggaaaatttctgaaacgtgcacagattccaagtgttttctgagaactttatgcttattgtagagtggttacagacactgaatgctaaagtgtattactctttgaaaagcattgcttgatttcttttggtgaattctgtaaaggtgcagggaaacataacgtcccaattattttttctttcttctttgtttgctgcctatctactttgaaagatacaatagttaaaacccagaaaagagattggaaaccccttagagaatgaaagacatccaagggctctaaaatgcggcagttgctgcttctgagaccaaaaaagggggcaaaatatagagtgtgtggttctacttgtgtgattttttgaaagaaagtatttgaatttatctaaaaatactaaatttgtatttacattagttttcaaatagaatttaataagtacagtgttctataggtaatattgagagaaatagaggacaatgaaacctctctcctccatcatcttgtatgaactaccaaaatgtttatcatatggacagttctcatatatagtcaaatagaaagaaagacataataggaaaacaaatgacttgggaaactaagctaacatggtctaattattctgacctctgctcacctaacttgatttaggaacaaatcattgagagttagagcatgaatagtcaagactgttagaccatatctcaaatatcagtgacttcaatcaactatgtttccagtttaagctgaataggctttattaaatagttgttgaatgaatggataaacaaataatgtactctggggattacctgataccaggattctgaattttcagatgtatcatagaaggatagcagctttgcaattaggtaaattgttaactgtgtcacctttagcaagttatttaatctctttgagcttcagcaaagtaggaataatcatatctaatttgaaaggtcgtggtgatggctagggctaacaaaaatctgattcacaacatgcaattaattaacagtagccatttttagtggttgaccaaaaaaaggatttatattttcaatgccagcacactcgatgttctgttgggaaaaataataatgatttttgtgtgcttctccatatggtataatggaatgatttgtggatggaaataaaactgttctaaaatttttgtgacagctggtttaaaaatcttaagtgcctaggcacattcttgattgagaagccacagttttaggccataaaagatgggggaaagatttttatatgagacaattttgtgagtgttactttttctttgtctgaaccatagtgaaatctaaacaaggatcttgtgaaacttattttaaagaagcagtttacttcaatgggatcttagataatttcaccagaaaatggatcaccgaaaccagaaggctggtgatcattatttggtttgggccatataagaattgaaactaacggcttagctttaggatttttaggacacttgttgataatttaggattcataattaacatatgtgttgattgttttctgagactaactgggcaatgggtttggatgtgtttacatttattctgattccagtcataaaattatgtcaaggactttccttgtctttttatgtgtatgacagatgtgtatgtatccatttcatctaacaagttaaagcgttcagctataatttaaaatttgtagcttcactgttttatagtacctaaaattggaatgtaatcagtcagaagacattcatccactgctttcattccagaagtattatgctttttgaagcagcaatagcataggaatgttgaggagactatactatacttttatagcatatttaatctcgtagatcacttttcaatgaattataaggctgatgacaaatgagcaaattgtatcagttttctttatgacatgtaacagagtatagctgtgatcatgaattggatagttctggtgtaaaaatctgctttatccccatataagatgtcaggttcagaaaagcaaacacatagtttcgaagagatgttgatcaaactgatgaggctaaatctcaagaaagagacacagttaccctctaatgttacactttgagttcacctttttttttttttttgagacagagtctcaatctgtcgccaagctggagtgcagtggcactatcttggctcactgcaacctctgcctcctgggttcatgctattctcctgccttagcctcccgagtagctgggactacaggcacacgccaccacacccagctaatttttgtatttttagtagagatggggtttcaccatattggccagaatggtcttgatctcttgatcttgggatgcacccaccccacctcagcctcccaaatagctgagattacaggtgtgagccaccatgcccgaccactttgagttcacttttaagaaaccatacttaatggaaaattaccagtaacagggcatactgtttaggatgcattcctaaaatattaatggcaaaagatagccagcctatggcaaagctaattggaaaaaatattttataaaggatgagacttctggataccatatgggaagggctctggttcaggaaaatgtttttaaaaaactgtcattgaagagaccatagaatcaaacaaaataatttaatctgtatgtaaaagaagttggtaccaccataatttttcttatacatgtcatataaggatctactctgtgtattgtcattgagggcagatataatttcttagttcatcattaactctctgaagtatttcacacagtagtttgtacaccttctaagtactcaatacaatgcttgagttcaattattggaaagtggtctcttggagaaaaaagaatcatagtgcaaaaccaattattttacatggacttttcctctatatctaagccctaataagaggcagctgtctgatatacatacatacatacatacatatatatatatatatatatatatatatatatatatatatatatacacacacacacacacatatatgtatatatatatttggagtaggggatggagtcttgctctgtcacccaggctggagtgcaagtggtgtgatctcagctcactgcaacctctgcctcctgggttcaagcgattctcctgcctcagcctctccagtagctgggattacaggcgcctgtcaccatgcccagctaattttttaaaatatttttagtagagacagagtttcatcaagttggccaggctgctcttgaactcctgacctcaggtgatccacctgccttggcctcccaaagtgctgggattataggcatgagccaccgcaccctgccaactgtctgacttatcttaaaaggctaaggacctggtttgtttgtcaaattttgaaaatagatgcctcagttcataagatttccatattgtgtggcaggcgcctgtaatcccagctactcaggaggctgaggcaagagaatcacttgaacccgggagacagaggttgcagtgagctgagatcacgccactgcactccagcctgggcgacatagtgagactctgacaaaaaaaaaaaaaaatccatatgtgaaaattcttagaagcttcctatacaatttcagctgaagattcagccaacagttcattctgagactgtgttccatggaaaaagtaaagcccaggcatggaagtgggaatggaaagaaagattctaagcctacaaatactcaaacatcaagaagaaataaaaataagtcatcacttcgacttcatgtgctaacatcactgaggttataaattcccaggaatattttattgcgggagcaagactgcactgctgcctttcagcttgcaaattccagtgagaaacgtctttctctctgctctcaactaactctacagaacgctgtcctctcatttcttcaggctgcagttctagagtagggactcagagtgccactgttggccagtctggaaacagagataaatgagccaatccccagacattccggcttggtggcttttctaatttcatggaatgcaaatccaagagcagacccacaacattcctattatggctcctagttctacaaattataagcaggaacggaacggatttacaggcaatgagttcagctccttcttggctggagattctataatccaagaagagtttgaaaaggggcttatttgggctggagcagcagcaactctaactgtggaaaaggtggggaatggtgctggactgacagtctgggtagaaccaaggcgactactgcctcctttcctgctatttctatcctgctgggcattctctatgatgcagatccgttattcagtcctagaggagctggccaagagtttggtggtgggaaaccttgccaaggatctgggactcagtgtcgaggacatgcccacttgaaagcttcgggttaatgctgaggaataatacttcattctaagtggggaaagtggagacttacttgtgaatgactgaatggatcaggagcagatacgccccccaattatagcttgggccataacgctttgaaatagttgaaggccaggcatggtggctcacacctgtaatcccagcactttgggaggccgaggcgagcagattacgaggtcaggagttcgagaccagcctgaccaacatagtgaaaccctgtctctactaaaaatacaaaaattactgggcatggtggtgcaggcctataatcctagctactcggggggccgaggcaggagaatcgcttgaacccgagaggcaatcgcaccactgcactccagcctgggtgacagagcaaggcgccatctcaaaaaaaatgaacaaacggtagttgaaaattctttaaatgtttttcacattaatatggagattcaggatatgaagaatcatgcaccacggttcagcaggaatgttattaagttacgtatctctgagtttacccagctggaacaagatttgcaacagaacctgcagaagatcctgatgttgagagaaattccttacaaaattatcaccttagcagcaactctatatttctctttgaagtaaaagtgaccaacagtggaaagacatatgttgatcctgtgttagagaagctgcttgactaggaaaagcagagctcccatcccttagtgctagcagccttagacggccccccaacaaagcagcatcactcaactcctgatcctattggttgaagccaatgacaaccctgtgttcatctaggatgtgtacagcgtcggccttcaggaagatgtgcatccgggcactcctgtgctgagagtgagggccaccaaccaggactagagtgtcaaggcagagatcacatatggcttcacaacccagagtacccatatctagtttggccttgatcaaatagtggagaaatgaaaactttaagtacattggacttttaaagatttttaatttccatggttttggtagcaagtgacagagagggactcattgtccagtgtacagttgagaccgaatttctagaagataatgacaatatcctagaggcgatttttacttctaattccacaatgattcccaaagattctgcaccttggacagtaatcactgtccaggatttaaatcacaagatctttaaatcacaagatctggattcgggagaaaacgaggtcacatgtctgatataagaaaatgcaccttgagaaaaatcttcctccaataattaactacatgcttgtaacaaatggggccgtggaccaggaacagacccaaggtataacatcagcatcactgccactgacagaggcaaaccaaccctctcgtccagcccaagcatcaccctactcattggcgatgccaacgacaatgctctggttttctaccaggcctcctacgtcgtccacgtggccaagaacaatcttcccaaagcctccatagtgtgcaagtagacacctccaacctagacttgggacccaacagccaagttccctattccatcgtggccagtgacctggagccacaggcgctgtgattctaggtgtccttgagcgcacagtgcgccttcgaccaagagcagccgcgagccttcaagctcacgctgcaggcccgcgaccaggactagctcgcgctcggcgtcaacgtgagcctgcgcgtgttggtggacgacctgaatgacaacgcaccgcgggtgctgtaccccagctctggagcgcaatggcttcgcgctcttggatatggtgctgcacgccgcggagcctggctacctggtcaccaaggtggtggctgtagacgcagatgtgagacacaatgcgtggctgtcctaccacgtgctgcaggccagcaagcccaggctcttcagcctggaatgcgcaccgacgaggtgctgacagctcgcacgatgggccacaggaaagcgactcgccagcgcctactggtcgcggtgcactgcggtggacagccgctcctctcgctaccgccacgtcaccaccactaccgcccctcgtcgccgacagcctgcaggagactctgccagacctcagcgatcactctgcaaagctacagcctgaatccaaaattaatttatatctggtgattgccttagctttaatttcctttttattcttcctgattgcattgtttgtgctggttttaaagtgccgaagaccccaaaatgatcctgtctgagtctttcccacggatgtctatcccgcgctaagccccaggtttctgggtaactgtagctctatgatgccatattcctaccaggtgtgtgcttctcctacgaatccagggctgagtgaacttcttttttgaatccctacccctcaggactcaatagcagtttcactgcagaaagccccttggggaaggggatgattgtgattattctaattgcttgggcagaatccactctccaaggtgaaaaattcttgatgaaactaagttcagtcacaagcaggttttcttctagcattaaatattttcagagatctcagtaaaaagcatttctagcagcaagaccaaaggcctaagatgagaaatatttggcatggtgagcttgagggacagtagtcaggcagacaagagtatcagacatgccagagcatttggggcctgtaggtaaggagcatgttttgattatatatatttgtatgtgtttgattatattttataattttactttgatattcaaattgtactgatccaaaaataagggagggacaaatcttggccattgtagtatgagagatgtaaatttacaactcagaatccctgcttatcacttctccttcagcacacaactgtttcattttctatttaagaaacttcctctcactgcaaaaagacattctggctgataaagttagcctataatttcagtaaatctaagaatatgactaatggaagttgccagacctaaactttgaaaattattgttccactgaagagcgtcttatgactgagtgttccagtctccttctcaagctgaaccttgcttttcaaaccagattaagaacactatcataagttatactgcattttatttccctacccatgtccactgcatcattctctatagtacaaagagcttgtctcgccaggcgcatctataatcttagcactttggggcgccaaggcgggtggatcacttgagcccaggagtttgagaccagcctggacagcatggcaaaaacccatctctacaaaaaaaaaaaacaaaaattaacaaggtttagtggtccatgcctgtggtctcagctacttgggaggctgaggtgtgaggatcacctgagtctggggagattgaagctgcagtgagctgtggttgcgctcctgtactccagtctgggtgacagaattagaccctgtcccaaaacaaacaaacaaataaagagcttctctccttatgacttatttaaagcttgggaaattgttccaattcaaatgctttaaatggacttgagctaaaacagaatgtggtatatgaaatgttcttataatcaggtgattgtaaaaattgatccagataatgttagcatagcattttactgaactagtagtttacaaacacttcaaaaattatagaataacatttgcatataaaattcctcatacatttccctatcagtgaattggaagcttacaatatacaatattaccaaaaagacaaaaaaaatgaaaaggaaacagttacctttggaaaacataattaggtaaaatgggtaatatggaaagtctgaaaactgaaaaaattactgataagtcaagagaaaaggaatattagtaggaaaattcataaaagtgtgtctgactactcacagcaggtttccttattggtatgtattctgtggtccatctaagctatgttaattttattttaaatgctacctgggtattggcttctaaaaggaattcagtaaatcagataatttggcatcttcaatctagattctgatgctcacctgaaaagtctgctaaggattggaaaccaagaaaagtgaagtatctcaacagatatgtgtcacttgtgtgtactggattttttttttttttttttttttttttttttttttttgagatggagtttcactcttgttgcccaggctggagtgcaatggcatgctctcggctcactgcaacctccgcctcccaggttcaagtgattctcctgcctcagcctccctagtagctaggattacaggcatgtgccaccacgcccagctaattttgtatttttagtagagacggggtttctccatgttggtcaggctagtcttgaactcccaacctcaggtgatcttccctccttggcctcccaaagtgctgggattacaggcatgagtcactgcgcccggtcgcgtactggatttatattgtgtaatactttgctctagcagtatagtaggtgagacagtgactgtgtctagtgagcaaaaggcacttatttgacacttttgactcttcctttctacttaccttatttaaaattgatttttgcatgtggcatgatgcaccagttcattgaggtaggggttgaagttatttcccatttttttcaataccatttattaaaaatattttcctctttctgttgaatttgcttggtgcctttgttgaaagtcatttcactgatatatgtagttctatttctatattcttgatcatgtttcatttgtctattcttttactaatagcacactgtctcaattattgtagctttatagtaagtcttgctacaaagtcttactacaggacaaagcttgtaggatttttgaatgggatggcattgcatctatacctttatcagggaaagagggaaggagggaggaggatcatcttaacaatattgacacttcaaatccatgaacatggtatatatttccatttaattaggtctttaatttctctcagctatgttgtatagttttcagtgtagagaggtcatgtatatttctcattaaattgtccctacatatttgatgttttctaatgttattgtaaatagtatttttaaaattgtatcttctaattgttcatttctagtttacagaaaaatgaaaaactatgtttttatgtattctatatgcttttgaaaagtaagaggtgcaaagtgctctattcttacactatattgtgtgagaatataagtcgaaaccactctgcataagttcaggcttccattctcttcagtttgtaggttgagagaacccatccagaaacagtaaacattggtgtctgcccaagtctggtcctgggtggttcattcattcatttacataacaaatatttattaactgtctgctatatgcaaggcactgacctatggactaaggatgcagcaatgaacaaggcatatatgattcctgagttaatgggccctattctaatacatgatattttacaggtctgataaaagccaacaaggagaaatacaaaagcactaagagaaagcttatagtagggaagcttcgcctaatctgaaggtcaaggaaggctttctttttttcggaaagtgatatttagagagatgaatagattaataggatgagtagaagttatctaggtaacaaggaaagtaaaaaagaaattgtcaggcagaggaaatagcatgtgtaaagatctttttaaaaaataaaaggtgtgactcaagcaatttaaaagggctagggaggctagaaacagaaaataaatagatgaaactaataaggcagggagagccttgtaaatcacacttaaaattctggattttgttctaaatacccttgtacttaggagctattaaaatattttaaacaaggcagtgacaagatatttgaattattaagcttactctggctgctatatggagaattgatttatgagggttataaatagaaataggaagataagataggagactatggcaatattcctggtaagaaatggaagaagagctggcttggattaaaggggaggcagtggatgtagaaataaatggatgaattatagatatatttaggaaatgggttcaataagacttaataatggaataggtggaatataaatttcatgagggcagggggtgttttgtttattattatattcctaggtgtctgaaaatattgttgtgttgcctggcaagtggtagatcttcagtgaaatattattaactgaataaatacaatggataaatggggagcagggattaagagtgattcctgggtttccacattaaggaactggatggacaaagctaccatttgatgagaatggaagactaaagaatgatagatttaagagaaatcgagttgagttccagccatgttcatttgaaggatctgagaaacagtgcagatattcagtgtgtgattagacatatggtcatcattcttttttttttttgagatggagtctcgctctgtcacccaggctggagtgcagtggccctatctctgctcactgcaatctctgcctcccaggttcaagtgattcttctgcctcagcctcctgagtagctgggactacaggcgtgcaccaccacgcctggctaatttttgtatttttagtacaagacagcatttcaccatattggccaggctggtctcgaactctgatctgcccgcctcggcctcccaaagtgtggggattacaggcgtgagccaccgcgcccagccggttaccattcttttactctgagttcttccattgtgatcatctagtcagatgggtagatccttataaggctgagcataataagcttcctgatagctctacactggtatgttttggggttcatggctgagctacttttgtgttttatttatcttcctgatctctttttcactgtaagaaacatccagcacccagggaaatttgctgtctaattcatactccactcttcagactagtcctagtgttcagttttgttttgttttttttctgtgtctggaattctattaaaatgtgtcaggctgttttaatttttgttgtttaattttctttcacatgattatatgtgctccatggatttttttgtttgtttgttttttgtttttgtttttgtttaagcggggtcttgctcttgtcgcgcaggctggagtgcaatggcttgatctcggctcactgcaacctccgcctcccgggttcaagtgattcttctgtctcagcctcccaagtagctgggactacaggcacatgccaccacacccggctaatttttgtatttttagtagagacgggtttcatcatattggtcaggctggtctcaaactcctgaccctggtgatctgcccacctcggcctcccaaagtgctgggattacaggcgtgagccaccgcacccggaggaaatttttaacctcagtttttcttcaccatctgtaaaactgcatagaaggaatgtttaggataaaagatgcataacaatcataacaaaattgttgggttttaatgttatgagtacacttggaggattctatgtccacacataccttaaacatcctatagagtccttagcattttaaagttgaaaccaacagtatgaatgatggtagaattttcccccccaggaagttagaactgttccatatcttgatagagggatgggttataaggatgtacacattttccaaaactcattgaacttaagagtcttgcatgtgactgtatataaattatactttaattgaaaataaatttaagaaaataaaattggctgggcgtggtggctcacgcctgtaatcccagtgctttgggaggccgaggtgggtgaatcatctgaggtcaggagttcgagaccagcctggccaacatggtgaaactctgtctccactaaaaatacaaaaattagctgggcatggtggcggacacctataatcccagctactcgggaggctgaggcatgagaatcgcttgaacccaggaggtggaggttgcagtgagccaagatcatgccattgctctccagcctgggcaacatgaacgaaatgccatcttaaaaaaaaaaaattaaaagaaaagaaaattagcctcccccaccctcactatacctcagactcacccctgaaagatcactactattcatccctggttatgtacacttacaaacattttctgtgtgtatgcgaatgtatgtgtggggttttctttgcacaacaggatcattttacagtatatatactgttgtgcaacttgctctttccacttaatatctcaaggaatcttttctttgaatctttatagccatgtacctcaatcttagtagttttctttattttatttttgaataggaaatacatttacatggttttaaaaatcaaaacaatatactatgtatatattgagaagtctgacttccatccctatcctactcctattccacccttgcttcctcctgtcccctgtaggtaaacattttataactttattaagcatcctgtcagcatttcttatgcaaatatgtacatatatttttatttccccattttttttacaaaaagataaaatactatacaccactttatatcttcctttcttcacattatatcctttaaaaatatttccatattggccgggcgcggtggctcacgcctgtaatcgcagcactttgggaggccgaggcgggaggatcacgaggtcaggagatcgagaccatcctggctaacacggtgaaaccccgtctgtactaaaaatacaaaaaaaaaaattagccaggcgtgatggcgggcgcctgtagtcccagctactctggaggctgaggcaggagaatggcgtgaacctgggaggcggagcttgcagtgagccgagatcgtgccactgcactccagcctgggcgacagagcaagactgcaactcaaaaaaacaaacaaacaaacaaaaaagaacttccatattaatatatagaaagctgttttttttaacagttgcttagcattcctttggattattaaccagtctcataaatgagcgctattgaatagccctgtacctacatcagtttttacatatgcagtatatctttgggatgaattcccagaaatggaattgaaattgctgggtcaaagaggaaataggtgtaattttcttaggtattttcacaagaagtgttaattctaactttctgttttgaaatgatttcaaattttcaaaggagttgcaagaattgtacaaagaactgtatctccttcacccggatgcaccgggtgaattatatgtattatataattgtatctgtaggccaggtgcagtggctcactcctgtaatcccagcactttgggaggctgaggcaggtggattacttgaggccaggagttcaagaccagcctggccaacatgataaaactccatctctactaaaaatacaaaaattagccaggcctggtaccccatgcctaagggtgaggcatgagaaatgcttgaacctgggaggcggaggttgcagtgagccgagatcgcaccactgcactccagcctgggcgacagagcaagactctgtctcaaaaaaaaaaaaaaaaaaagtaaaaaagttttttaaaaagatgtatctatatatacatatttacatacacacccaagtgtgtatgtatatatgtttgtgtgtatgtacacaaacacattatttttatatgatatgatttttttatgacatgattatttttatgacatttgagagtaagttgtagaaattatgtttctttattcctaaatacctcattgtgtatttcctaacaaggacattcttttatataattaaattttaataataaaaatcagaaaatttaacatcaatgcaatataattatttagcctatagtccatatttaaattctaccataccttatagtatattttactatacctcatagtaattttttttagtccaaaatatcacacattgcatttagttgccatgtctcttttttttttttttttttgagacagggtctcactctttcgcccaggctggaatgcagtggtatgatcttggctcactgcaacctccgcctcccaggttcaaatgattctcctgccttagcctcctgagtagctgggactacaggcatgtgccaccacactcccaccacacccagctaatttttgtatttttagtagagacaaggtttcactatgttggccaggctagtcttgaactcctgacctcaagtgatctgcccacctcagctaagtgctgggattacaggcgtgagccaccatgtgtggcctagttgccatgtctctttaatctactttaatctgaaacagttcctcagccttgtttgtttatatgaaactgacatttgtaaagactagaagccatttgtcttgtataatgcctttaatttatatttgttttatgtttcctcgtgattttatatatagagtttgtttgtttgtttgtctgtttgtttgttttgagatggagtctcattcttgtcacccaggctggaatgcagtggcgcagtctcggctcactgcaacttctgcctcccaggttcaagcaattctcctgcctcagcctcctgagtagctgggattacagatgcctgccaccatgcctggctaatttttgtacttttagtagaaacggggttttgccatgttgcccaggatggtctccaactcctgacctcaggtgatccgcccgccttggcctcccaaagtgccgggattacaggcatgagccaccgtgcccggacctcatgattgtatttatttatttatttaatattattattattatttttttttttttgagatggggtcttgctctgtcacccaggctggtgtgcagtggtgcgatatcggctcactgcaaccgctgcctcccagattcaagcaattctcctacctcagcctcccaagtagctgggattacaggcatgtgccaccacacccggctaatttttttgtattttttttagtagagacgaggtttcaccatattggccaggctggtctcgaactcctgaccttgtgatccacccaccttgacctcccaaagtgttgggattacaggcgtgagccaccacacccagccttatgattgtatttagactagacatttttttggtagtatattatttagccattgctgtgtaacaaattatcccaaaacttagtggcttaaaagaagcatttattatctcataaattttgtggatcaggactgggtatagctttgctgagtgcctctgcctcaaagtcttacaaggcagcaattaaagtgtcacctaaggctattgtcttatctgaagggtcaacagaggatggatccgcttctaatctctctcacatagttaatggcaaaattaagttccttgtggattgttagactaagggttccagttccttgctggttgttagcttgaggtctacctcagttccttgccatgtggacctccatagggcaaccagcttctgttagagcaagtaaaggagagtgccagagagggcaaatgtgatgaaagccacaatctttttataaacctaattttgaaagtgacatacaaggctaggcatggtggctcaaacctgtaattccagcactctgagaggccaaggagggtggactgcttgagcccaggagttcaagaccagcctgggtaacatgacaaaaccctgcctctactaaaaatacaaaaattagctggtctggtggtgcatgcctatagtcccagctactcaggaggctgaggccagagaattgcttgaacccaggaggcggaggttacagtgagccgagatcacaccactccactccagcctaggccacagaatgaaaccctgtcaagaaagaaaggaaggaacaagggagggagggaggaaggaagggaggtagggaggcagggaaagaccgagaaagtgacataccatcatttttgctgtagtttgttcattagaagcaaaatcacttggtccagcccacactctggggagatgattttctaactccatttgtaataacttattctacttttattagttggcattatacagtaagaaagagctttcttttctcttcttatttattcatatatggctcatgtgttttttccaatgagttatattctattactaacattttttattttgacctcaaattgttttagatgttaccaataagaacctcttcaagctggttcttgtgtccttttgccataactctctcattttcttgaaccctttcttactttctgatataagaaaatattagagactcatactttccttgttccagttctgagatgaaccatttatccaaaagccttgcttcattttagtagggaatagtatttagaaactaagatctgggtgtgaggtatgctcactgctaatgggctgtcactgtttctaggccttgtcagcagacggagctaggaaaaacacacataaacacacccatatttatatttgtacacacactccctcaaaatcgtgagttcatattgatacctccagttctggttcttcctagccttccccctttccatctttgtatttttattttccaacagtaagaaccctggctcccagtgctatgaatatatttactcatttgctccatccactgcactccagcctaggccacagaatgaaaccctgtcaagaaagaaaggaaggaatgagggagggagggagagaggaagagagagaaggaagaaggaagggagggagggaaaactgagaaagtaacataccatcatttttgctgtagtttgttcataagaagcaaaatcacttggtccagcccacactctggggagatgattttctaactccatttgtaataatttattccacttttattagttggcattatacagtaagaaagagctgctgaagatttgcttgcaattggttgtctttaaactgagggtatattgtcaaagtactgtgctgaaaagttacctgtagtatagttatgtgattcattaaaataaagtttgtttctattatgtgcagttttagagttttgccacactctggttgattagtatattttctgttgcttttttgttttgttttgttttgttttgtttttgagatagggtctcgctatgtcacccaggctggagtccagtggtacaatcacagctcactgcagcctcaacctcgtgcacttaagcgatcctcccacctcagcctcccaaatagctggggctgcaagtgcacaccaccatgactggctaattttttaattatttatttatttatttatttattttagagatggggtctcactatgtttccccaggctgaccctgaactcctggggtcaagtgatcctcctgccttagcctccaagtgctggtattacaggcataagccaccacacctagcctagtattcttttttgaatatgtaaaacattaacataaagtcaaaactattaaaaaaaggtgtactcagaaaattgtcattcctcccctataccttctgcctcattcacaccacactctgtagataatcgatttcattagtttgtggtttatcctcactgtgtttctttttgcaaaacgcaaaaacaaaacctatacatatttatattttcttatgtcctcttctttcttacacaaaaggtaacacactatgtaggtagtcctggctttgaacagtttcactataaaaatatttgttactacagcttaaataacataagtctcctaaaaataattcaaattttagttaccatggtatattaactttgagtagttccataaaggacaaacttggctgctagcccttcagtccacagagcactttgaaaataacagatgagcaaaataatgtggccaatcacatgacttctttcaaagtatgtcagtgatcagtcactgtgtgcctataatttagttcatgcacagacagcaaagcatgtagttgtgttgccttccagtgataaacccacataacattttagaaaaatgtattaagaattggccagcaaagataaaagtgcagcaaagaaacaaaagtgataatgttttcagtgaaatttgaattgaacataaatggagttatagaagaaatagctgaccatgggaatgttcacactgctactttcaagaatctctagaagggcagctaaaggagcttagtgaaggtgaatttattgacatgaatgagaaaagtaattgtgatgaaaaggatgaagatgtcccagagaaagtaatgccagcaaaaacttcacattaaaggaactctcagatatttcaaagcattgaaacctccaagaataaataaaatgttggaagttgatccaaacttagaaaggagtatggcaacttgtcaagatgaagaaaaggtgcttattcctttttatttatttatttagagacagagtttcactcttgttgcccaggctggagtgcaatggcatgatctcagctcaccgcaacctccacctcctggattcaggcagttctcctgcctcagcctcccaagtagctgagattacaggcatgtgccaccacgcccggctaattttgtatttttagtagagacagggtttctccatgttggtcaggctggtctcgaacccccaacctcaggtgatctgcccacctcggcctcccaaaacactgggattacaggcatgagccaccatgctccacctgcttattccatattatatgttataggatgaaaagaggccaaactaatcttgacatgttttttacaaggaaataatcctccatggttctaatttttttttttttttttttttttttttttgagacagagtcgcgctctgtcacccaggctggagtgcagtggcacgatcttggctcactgctagcaccgcctcccgggttcacgccattctcctgcctcagcctcccgagtagctgggactacaggcgccggccaccacgcctggctaattttttaaaaaatatttttagtagagacggggtttcaccgtgttagccaggatggtctcgatctcctgacctcgtgatccgcccgcctcggcctcccaaagtgctgggattacaggcttgagccactgcgcccggtgggtctaatgttttaaattacactgtgttaaataaatattagtttgttggttttttttttagtttttttatttctctacaaatttacaaccaataagagtttttaatgctttgacaaaaaatgttaaaggtcatagtacaatcgcatttcttcccattgattattaacatcactttacatagtttcatcttgcattagcaattttgtgtgtgtgtttgtggttttaaggagcggagagtttaataggcaagaaggaagggagaagacagaaggaaggagctcccccttacagagacagagggagcggggctccaaaagaggaggtccccatctaccgcggataccagccaggtatatatgcagaggctggtggaggtgatgtctgatttgcatagggctcaggggattggtttgaccaggcatatcattcacgtagcccgagaaaaagctggccctcccaccccagccttttaatatgcaaacgtagggcgccatggatgttctaaacacgtggagatatgtggggggcagccatgtggccaggaacttgtggggcaagggcaagaaggctgtgggaatcgccaagttgaatggacctagtttctaatggcctgcatttgcatatcaaaggttgctggcctggctcctagagccggggctttaaaagaaacttttccggagatgctttaaaaaatgaaaacttcccaaggaccccttttcctgtctatctgcataaaataatttcttttattatttatttatttatttatttatttatttatttatttatttatttatttattttgagacggagtctcgctctgtcgcccaggctggagtgcagtggcgcgatctcagctcactgcaagctccgcctctcgggttcatgccattctcctgcctcagcctcccgagtagctgggactacaggcgcccaccaccacgtccggctaattttttgtattttcagtagagacgggatttcaccgtgttagccaggatggtctccatctcctgacctcctgatccgcccgcctcggcctcctaaagtgctgggattacagaataatttcttaataactcctaccacattcctccctgtggcgatatcaaactaactgctgttaggaggctttgggcgaccattgcttctggctacttcctgctgaaaaggggcgtctaatggagaacagcagctagggctcctcctggggttgatctaagggtcctcggaagaatggcgtccatgtgtggttcagtttacagcaccgtttggagtttgattgcttctaggcgagaagaaacaattcaagttatagtattgagtatacagagtccaaatatcaatacaagacatataagcaagagagtgcttaataaaggggttaaccaattccataaagaagactggaagtaattaaagagggattgtagccactcggggctgaagcccacattttccctgagcctgtcaataattttgatttgatttttaagtccctgtagatttgcctcttctttactacaggtgttaatcccaaagaagcatgtttcatttaaaaatgcattactggccaggcgtggtggctcgcgcctgtaatcccagcactttgggaggctgaggcgggagcatcatgaggtcaggagtttgagaccagcctggcctacatggcaaaaccccatctctactaaaaatacaaaaaattagccatcgtggtagtgggcgcctgtaatcccagctaattgggaggctgaggcaggagaatcgcttgaacccgggaggcagaggttgcagtgagccgagatcgcaccactgcactccagcctgggcaacagagcaaaactccatctcaaaacaaaacaaacaaacaaacaaacaaaaactgcattactaaatccaataaaaagtcctagtagactcagtgatagtaaaactttcatgcttcctttttgccagtaactattatccctgctataaggatactaattaagcaaaatacgacagcaatggaaactctgtccaatatttcagttagaaggtgctaccatggataaccctattgcaaatagtagagtgaggaaagcagttcccacaaatgtggtgtggtaggtaatttccatctaaaattttacttgccaacatatagaattcccctctgtgggcctacgaagttccttggttttattttcccaaacaaagaaacctccgggttacaggtaccttacttactttcattacctggcacaatttgcaaaataattgcccagaactagcatattgattcacattttcacattacccatccctttttcccccccaccaagctgcagaagatcaccacttgattcacaggaataagcagggccagggttagtctaaaatgtaggcaaaaagcttaaaaacaattaatgagactagggtttaatgacaaatgtatgataagctttggagcaaaatttttctctccagtcctcatttttggtaaaaactaattatgaatgaactttaatcttatacttggcctgattatttgcatgaagtgcagcaagaatggttatttctacataggacttttggattggctttgatgaaacactgttccacaaggaatttcagattagacttttaaagctgagcccagacatgggtttgtatcctctaatacctgtgagttgggttatcctctcctcttgaggtcccaagataaactcagagcttccagacctgttagaaagtgacattcttcactgaccacaggttaggaaccctgtgtggggactgtgtagacaaggtgtgaggccagttctccccaaggggcttttattggctctgcatgtcaagcttgattccttaaagggaaacacaccctttcagttaaagccttggcaaaataaccggtttttccaattgtgttctgttgacaaagaaaaatggattcttgctgcactgatgcgaacaactatattgccgtaagttaagagtacttacagatagtctccaaattttagaggaaccaggcagagaaaaatgaacatgctccaaattttgttcacagtagtataccttacttgattattaaaggccataaatagtttaaaataagtttcctttcccagtccatgcaccaaaatgatacggctctgatgagtggaggaacaacagggttcctggtcctcatgctggtttagataaaatgacacagacacatgtggagtggttttaaggagtggagagtttaataagcaagaaggaagggagaagagagaaggaagacgctcccccttgcagagacggagcgggggttccaaagctgaaagaggaggtcccccacattaacaatttttaaaataccgtacaactgcagaaaatgaggactgcctgtacatactgtttgacactttgtttttttttttaacttatcaactttattttgtttgtttgttttggttttgggtttttgtttgtttgtttgttttggagacgagtctcactctgtcagccaggctggagtgcagtggcacaatcccagctcactgcaacctccacctctcgggttcaagcaattctactgcctcagcctcccgagtagctgggattacaggtattcgccaccacatccagctattggttttggtttttgagacagggtcttgctgtgtcacacaggctggagtgcagtggtgtgatctcagctcactgcaacctctgcctcccaggctcaagtgatcctcccacctcagccttccaagtagctgggactacaggcatgcacaccatgcgcagctaattttttctattttttgtggagacggggtctcactatgttgcttaggttggtcacaaattcacagcctcaagcagtcctcctgcctcaccctcccaaagtgctgggattacaggcatgagccaccacatccagccttaccagctatattgaagtataatttatataacataaaatttgccttttaaaattatacagtgcaatgcattttgacaattgtttacatctgtgtaaccaccatgcaatcaaaatatagaacatttctataaccttcaaaagttccctcatgcccctttgcaatcaattcactacttctccagctccaggcaacaactggtctgcttcctgtcactataaattagtgttgcctctttcagaatttcatctaaatggaatcctataacatatactattttgtatccatcttcttttactccaaagttcttgaaattcattcatgttcctgtgtgtatcagcagcgtgttccatttgattgttgagcagtattgcattgtgtggatatatcacaatgtgttcattcattcaactgttggtggacatttgagttgtgtccagtttagtgctattctgaattaaagtgatgtgaacaatcatgtacaagtatttttgtaggcatattttttttatttctcttggataaataccccaaaacagaattgttttgggggtcatatgaaatgggaagtatatgcttaactttataagaagctgccaaactatttttcaaaatggtaatatcactttacattttcatgagcaatgcataaagcgttccgcttgctacattttctcaccaatgcttcctattgtcaattttttaaattttagcaattctagtgggtgtgtgatactatctcattgaagtttcaactgtttttccctgttgactagagacactgagcaacttttcatgtgttgtctatttgtatatcttcttgaagcattcgttcatctttaactgagctgaacgccttcttaaaattgagctatgggagttttaaaatatatccttgtagctgggcgtgatggcaggtgcctgtaatcccagctactcaggaggctgagacaggagaatcgcttgaacccaggaggcggaggttgcagtgagccgagactgcaccactgcactccagcctgggcaacagagtgagacttcatctaaaaaataataattatacatgtaattatatatgatttttatatatgtaatatatatattcttgatgtgagctctttgtcacatacatattttgtggatattttatcccagactatgacttgtcttttcattttcttagttgtgtcttttgaagagcagaagatgtaattttgataaagcccaatttattttttcttttatagtttgtatttcttatgtcctattcaaaaactccttgcctactgaaaacttatgatgattttctcctatattttcttttagaagttttatagttttaccatttataatttggtctatgaatccttttgagttgatgtttatgtatggtgtatggtgtgaggtaacaatgaagattcatatttttttccaaaggaatatccaattgtctctttggaaaaatatgctgagaaggctatcttttccccaccaaataatcttagcaccttaatcaaaaatcatttggccatggacatatgtaggtgtgggttttttctgggctctctgtgttagatggatagatagacagatacagatatataactgtgtttacacatatgtaactgtaaacacagttatatatctatatatccaccaacagttgaatgagaataaactattgttataagcatatatacacattgtatatatatgtgtacatatacatattgcatatgtatgtatacatatatacacacaaagtatatatatgtatgtatacatatatacacacttaaagtaatggcctccagttcgatccaagttgctgcaaaggacattatttcatgccttttcgtggctgagtaatattccatggtgtatatatatatatgtgtgtgtgtatatatatgtattatgtatatatatatgtgtgtgtgtgtgtgtgtgtgtatatatatatatgtgtatatatatataccacattttctttatccactcattagtcgatggggacttaggttggtttcacatttttgcaattgtgaattgtgctgctataaacatatgtgtccaagtgtctttttcatataattacttattttcctttgggtagatacccaatagtgggattgctggattgaatggtagatctgttttttgctctttagagaatctccatactgttttccatagaggttgtactaatttatattcccagcagcaatgtgtaagtgttctcttttccccacatccacaccaacatctattgttttttgactttttaataatggccattcttgcaggaccaaggtggtagctcgttgtggttttaatttgcattttcctgatgattagcgatgttgagcattttttcatatgtttgtgggccatttgtataccttcttttgagaaatggctatttgtgtcctttgcctactttttaatgggattgtgttttatttttcttggtgatttgttagttccttgtagattctggatactagtcctttgtcagatgtgtactttgcaaagataatattttggatgttatatttccattataatttagttcaaagtattttctaatacaccttgcaatttcttctttgacccatggattattttaaagtttgttattttgtttgtttattttgagacagagtttcactttttttgcccaggctggagtgcagtggcacaatcccggctcccagattcaagcgattctcctgcctcagcctcccaagtagctgggattacaggtgcccaccaccacacccagctaatttttttttcttttttttttgagacagagttttgctcttgttgcccaggctggagtgcaatggcacgatctcggctcactgcaacctctgcctcctgggttccagcaattctcctgcctcaacctcctgagtagctgggattccaggcatatgccaccacgccaggctaattttgtatttttaatagagacggggtttcttcatgttggtcaggcgggtcttgaactcccgacctcaggtgatctgcccgccttggcctcccaaaatgctgggattacaggcatgagccactgcacccagtccaattttttgtatttttagtagagatggggtttcatcatgttggccaggctggtcttgaactcctgacctcaggtgatccgcctgcctcggcctcccaaagtgcagggattacaggtatgagccaccatgaccagcctaaagtgtattgtttagtcaccaaatatgtaagtattacccaaatatatttgtcactgatttctaatttaattgtattgtgatccaaaaatatacattgtatagtttctattcttttaaattcgttaacatttcttttatggcacagaatatggtctatcttggtgagtgttgcttacacacaactgtgtaactgaaaactgtgtattctgcttctcgtggttgttgtatcctataattgtcaactagatcaagttagtaagagtgttgttcagtgatcttttcttcttcagtgtttactgtatttgctaatcccatccagtgaagtttccatttcatatattgtatttttcacttttagaagttccatttgactctttcatttccatcctcaattatcttcatatttttctttaaatttttgagcacatttataatggaggttttaaagtccttgtctgctaattttgtcacctctgtaattcctatgatgattttcttcctggcttggggtcataatttgttgcttatttgcatgtctaataatgtttttattggacagcagacattgtaaatgttatatttttgagtgtttggattttgtctttctttaagaactattgcagtttgttttggaaggctattatgttttttgcagatcaggttgatcttttcaaggcttgtttttaagctttgttaggacaggtctgtagtaacttttgccttgggctaatttagacctaccacttaattctgacttttttgattaatctgagtgttcagcagggtctctttattatggctaaatgaaattcaaacattttccagccctatgtgaccatcaagaattcagctaatagctccctggcagttcttcgcccagctgcagaaaagtgtcagtgcactctatgtatgctcagattattatttagccaaagacttggggatccatattaatattcctggagttctttgtgtagctccattctctttagtactctatcccataaattctggctgcctcaatctcctaatctccccaaactctaatatctattcctcaactcagcaaaaccatggtgttattcttggatttcccctttcctgccccacagtctgaaagttgtctccaggcaaaaaaaatggagatcctagtttgcggatcctcatttccttctccttttttttttttttttttttttttttttgagatggagtctcgctctgtcacccaggctggagtgacgtggcgtgatctcggcttactagaaactccggctcccgggttcatgccattctcctgcctcagcctcccgagtagctgggactacaggtgcctgccaccatgcccggctaattttttgtattttgtttagtagagacggggtttcaccgtgttagccaggatggtctggatgacctcgtgatctgctcacctcggcctccaaaagtgctgggattacaggcatgagccaccgcgcccggcctgcttctcttctcttatgggttagaatcctgcactgtcttttgaacaaatgtctaaaagcttttatcacacattttgatccacttcccagttgttatagtggtatatctggtttcacatgactgaaaggaaaagttttcaccttgctttttgtactaataatatatcctggaaatcattctatataaatttatagaaatcttcatttttaaaatagcttcataaaactccattgtaaaaaccaggtgcagtggctcatgcttgtaatcccacactttgggaggccaaggcgggtggatcacctgaggtcaggagttcaaggccagcctggccaacatggtgaaactccgtctctactaaaaatacaaaaattagctgggtgtggtggtgggcgcctgtagtcccagctacttggaaggctgaggcaggagaattgcttgatttcaggaggcggagattgcagtgagctgagattgcgccactgcactccagcctgggctacagagcgagactccgtctaaaaaaaaaaaaaagcaaaaaaaaaaactccattgtatgtgcacatatcattatctgttcaacccatctatgacttgtcatttaggtagtttccatccaatatttttgcaatataaaaaatgctaatgaagaacctgagatatatatatatctatatatatagatatatatgtttgttgttgttgttgttatttttgaagtatgtacgtataataaattcctaatagtgtgattgctgcatcataaggtaaaggcatatgtagttttgttaaatatagctattccccatcttgcattcctacaaatagatgagaatgtccattgtcccatagtctcctttgcagagtatattgtcaagctttttaattgttgccaacctgatgggtaaaaagatatctccaaataattttaattaaaatttctcttattatgaatgaggttaaatagtttttcatatgtttaaaagccagtttatatctttttgtttttttagagacaggaatcttgttctgttgcccaggccaaattgcagtgatgcagtcatagctcactgtagcctcgcactcctgggctcaagcaatcctcctaccttagcctcccaagtagctaggactacagatggatgccaccatgtccagctaatttttttatttttttgtagagatgtgaggtctcactatgttgcccaggcttgtcttgaactactggcttcaagtgatcctcccacctcagcctcccaaagtgctaagattacagccatgaaccaccacaaatgaccctatatatttttttgaattgtctgttcatgtcttattttcatttttctagtagttttttttttaagtgttttagcctaaatttgtaaaaagtttaggggatatatgaagggactctaaatgtttatgaagaaatttaattaaaagataaaaataaaaatataagctttatttttcaacatgagctccatcaagttcaaggcacttttgtaagcaatgatactagccatttagttcacccctaaagaactgagagtcctgggaatttagccatgtcaatgcagtattttttatattggttactgaagaaaaaatgggtgccctttaaagttgtaagattaggaacaaaaacaagtcagaagaagccaaatcagcactgaaaggtgggcacttaatgattacccaagaaaactctcaccaaattgcccttgcttcatgagaggaatgagcgggagcattgtcgtggtcaggaaggattctggggaagttttcccaggcattttttctgctgaagctttggtaactttctcaaaacactctcataataatcagatcttatcactctttggccctccaggaagtcaaccagcaaaatgctttgaacatcccaaaaaagcgcttgccatgacatttgctcttgaccagtctgcttttgcattggtcaaatgccaccacttccacctcttgtgctttgttttcaggatcagactggtaaagtcatgtttcatctcttgttacagtttttttttttttaagaaacccttcaggatcttgatcacatttgtttaaaatttcaactgaggctgggcccagtggctcatgcctgtaatcccagcactttgggaggccgaggcgggcaaatcacgaggtcaggatttcgagtccatcctggctaacatggtgaaaccccatctctactaaaaatacaaaaaattagccgggcatggtggcaggcacctgtagtcccagctactcgggagggtgaggcaggagaacggcatgaacccaggagacggagcttgcagtgagctgatatcatgccactgcactccagcctgggcaacagagtgagactccagctcaaaaaaaaaatcaagtgaaaactctggtcttaaactgcagctgatctattttatttttattttttttcagacacagccttgctctgttacccaggctggagtgcagtggcaccatcatggctcaatgcagccttggcctcgtgagctcaagcaatcttcccacctcaggctcccaagtagctgggactacaggcacatgctaccatgcctggataatttttttgcagctaatctagatgtaatggttttggcacccatctaatggaaagtttgctcaactttaatttttcagtcagaattgtgtaagctgaaccgagatgtctatggtgttggctattgtttctgctgttaattgtaggtcttctttaattagagcacagacaagatcattttttttcctcccaaattgatgtagatggtcttttgctgtgggcttcatcttcaacattgtctcatcccttcttaaaacaagctagctacttgtaaactgccgttttctttggagcattgtctccataaacttttcacaaaacatcagtgatttcaccgttcttccactcaagcttcatcataaatttgatgtctgttcttgtttccattttagcagaattcatgttactctgataggggctcttttcaaactgttatcttattcttcttagtgcctcaaactagatcctattcagacatggtataacaagttagtatgggtttattttggtgcaagaaatattttgaaatccacacatttttttcataatatgcattttccatgaagtttttgaaaactccttgtattaggaatattagtcctttgtccagtaaacagactgcaaatattttctcacagctcatcatttaccttttggcatttttttgcaatgcaatttttttccctttgtttttgttttttgtgtaatgaatcaatgttttcttttttttttttttttagaccaagtctcactctgtcacacaggctggagtacaatggtgcaatctcagctcactgcaacctctgcctcccaggttcaagtgattctcatctctcagcctcccaagtagctgggattacaggcacatgccaccatgcctggctaatttttgtatttttagtagagatggggtttcaccatgttggccaggctggtctcgaactcttgacctcaagtgatccactcacctcggcctcccacagtgctgggattagagacgtaagccactgcccccggccaaatcaacgttttcttatattgcatttaggttttaagtcatagttagaaagcctttccccacacctaggttatagaaacattcattacttttttcttccagtgctagtacttgcatggtttttggtttccacatttagatccctgatctaattggagtttattcttttgtgtgctgagatatggatctgattatatcttttttcccaaatggctatccagttgtcccaatgccatttattaagcacttcatctttgtcccagtgatttgagatagcatctttatcatgtaccaaacttctatagtgccagaagatttttattttttttagacagggtctggctctgttgcccaggctggagtgtagtggcacaatcccagctcgctgcaacctccgcctcacatgctcaagtgcccgcacctcagcctctcaagtagctgggactacaggcacatgccaccacaccaggctgatttttatatttttttgtagaatgagatttcaccatgttgcccaggctggtctcaaactcctgagctcaagaaatccgcccacctcagcctcccaaaatgctaggattacaagcatgagccaccacacccggctgccagaaaattttaatgatcagaaaaccacaattctttcttcctctgttatatgttgaagtaaaatacttcatttagaaaactaagccgggcacagtggctcacacctgtaatcccagcactttgggaggttgaggcaggcagatcacctgaggttaggagtttgagaccagcctggccaacatggtgaaaccctgtctctgctaaaaatagaaaaatttgctgggcatggtggcgggtgcctgtaattccagctacttgggaggatgaggtaggagaattgcctgaacctgggaggcagaggttgtggtgagccgagaccacgccattgcaccccagcctgggcaacaagagcaacggtaaactccatctcaaaaaaaaaaaaaaaaaaagaaagaaaaaagaaataactcagccatacaaggctacccatttggtgagaactaataataagttagatagcaaggtaatagcaaaatgtgggtgcaaaattaaagcaagttatttctgaggagaatgtaggtctcatggaagattttcatgtggacaaatttagtaaattttttgcaggtagtttcctgacatatttaacatttgtgatatagtaaacaataagaaggtactaaaggctgggcgcggtggctcacgcctgtaatcccagcactttgggaggccgaggtgggcggatcacaaggtcaggagatcaagaccatcctggctaacacggtgaaaccccgtctctactaaaaatataaaaagttagctgggcgtggtggcgggtgcctgtagtcccagctactcgggaggctgaggcaggagaatggcgtgaacccgggaggcggaacttgcagtgagccaagatcaagccactgcactccagcctgggcaacagagcgagactccatctcaaaaataataataataataataaggtactaatatgatccagactagaagagaatagcactaaaatgggagatggggtaaacctgtggttttttttaccttaggcttttgacttccaaaattattgtttttgctgggtgcggtgggtcactcctgtaatcccagcactttgggaggccaaggtgggaggattgcttgagcctaggagtttgagaccattctaggcaacaaagcaagaacctgtctctaaaaaaatttaaaaattagccagaaatggtggcacatgtctgtagtcccagctacttgggaggctgaggcaagaggattgcttgagccttttgaagttgaggcttcagtgagccatgatcaccccactgcactccagcttgggcaacagagcaagaccccatctcaaaaaataaaacaaaatagactgggcacgatggctcacgcctgtaatcccaccactttgggaggctgaggtggatggatcatgaggtaaagagatcgagaccatcctggccaacatggtgaaaccccgtttctactaaaaatataaaacttagctgggcgtggtggtgcacacctgtagtctcagctactcgggaggctgaggcaggagaatcgcttgaacccgggaggtggaggttgcagtgagccaagattgtgccactgcactccagcctggcgacagagtgagactctgtctctaaataaataaataaataaaacaaaataagtaaaataaaataaatgtttgtagttccaaaatattttgatgacataatttcttcttgttctaataaaactacatatgcattggtcctatgacctagtaatcacactattaggaatttatcataaatacacacctcaaaaattacaaaaatacatatataccagcttatttattacagcgttatttgtaattgcaaaaacattgtagatagaatggaggtcacataaaacttattcttaagattcagaccgggtgcaatggctcacgcctgtaatctcggcactttgggaagccgaggcaggcagaccacccgaggtcaggagtttgagaccagcctggccagcatggtgaaaccccatctgtaccaaaaatacaaaaattagctggtcgtcgtggcacgcctgtaatcccagctactcgggatgctgaggcgcgagaactgtttgaaccccggaggcagagactgtagtgatctgagatcatgccactacattccagtctgagcaacagagcaagacttcgtctcaaaaaaaaagatcatagatcatcttatcaaatcaaagtatgcaaaatattcaagtaaacttcagataaatatgaaggctaaaccattcagcttcttcaccaaacccttgaatgtcccacctgtctaaatggagatacatgtttgtttgatttattggttaactgtttttattccatttttcctcaaatgatcccataatttgaccttaggaagctgttcaaatagacacattaggttgaatggaaagactactcgatgatatttaggattttaagaggattttatgtattttttccttgtgtgcaataatttaatagcatcttgaataggattttctgatattactaaccctctgggaataatattaggtaattagacagttagctaatattaaaatatgtatcaggtaatatttattgagagtttcctctgtgccaagcaggatcaacttcataggcaggcgacctgtgcggggacacagggcttcatgcttagataggcccccttgctttgaaggcccctaccctttggttagggctctgctgttaccatcttgaaattcttaataatttttattttatttttttgagtcagggtcttgctctgtcgccctggctggagtgcagtggactcactacagtcttgaattcctgggctcaagcaatcctcccacttcagccttctgagtagttaggacgacaaacacacgccaccatgctcagataagttttttgtttgtttgtttttttgtttttgtttttgttttttgtagagatgggactgtccctatgttgctcaggctggtctcaaattcctggcctcaagtgatcctcccacctcagcctcccaaagtgctgggactacaggcatgagccactgtgcctggtcaatcatttttattaacaagcccaagccctcttttttttttttttttttttgagacagggtctccctctgttgtccaggctagagtgcagtggtgcgatcttaccttcactgcaacctctgcctcctgggttcaagtgattctcctggctcagcctccctagtagctggaattacaggcacccacccccatgcctggcaatttttttgtatttttagtagagatggggtttcaccatgttggcaaggctggtctcaaactcctgacctcaagtgatccacccaactcggcctcccaaagtgctgggattacaggtatgatccactgcgcccggcctccaagccccctatttttattttgcactgaccctacaagttacgtagctaggcttagttatgtttttagcaaggaaagtgtataatctcatgtaccttttgaaagattactcaggtctctgcatgtgaaatggaatttagggaatgcaagagagggagtaaaaataacagcgaggaagctatgatagcatttaaggttgctttgactcaggggtagcagtagatagggtaagtaattgatagtttcaaaatatattttgggagtagtaagcattggtatggattagtaatatactggatgtggggatgcagaaaaaaatattaaaaattacttctgaaattctggctggaatagaagtgccacttaccaggtaaggaaggttggagacataacatatttgagggtgtggtcaaaagatgagtttgacattatgctatgtcatataaaagacatataaaagactacctattttataattcctttttaataaaatattcagaaaaagcaaaactgtggttgcctgaggctgaagctaggaagattgactacagacaagcatgagggaaattttgggggtgatgagagttttctaaaactggattgtggggttggttgcattactgtataaatttattaaaaatccctgcatcgtataggggcactatattgtatgtagaaagctgtgaaaagattttaaaaatgattgacatgtctgtggttatatcaatgagtactattattattcccattttatacataaagaaaataaaagagaagttaaaaataaaagtttcatggttacatagctactaggtgtaatatccagtattggaatttgaatctttttgacactaagaccttactctcgatcatataatacattcactttctattttaaagttatattatagccgggcacagtggctcacacctgtaatcccagcactttgggaagccgaggcaggcagatcacgaggttgggagatcgagaccatcctggctaacacggtgaaaccccgtctccactaaaaatagaaaaaattagccaggcgtggtggcacgcacctgtatcccagctactagggaggctgaggcaggagaatcgcttgaacccagaaggcagagcttgcagtgagacgagatcgtgccactgcactccagcctgggtgacagagtgagacaccatctcaagaaaaaaaaaattatattataaatgctgcatctcattggtcagaagctctcttgaaattataaaacaaagaagaaaaaagataaagactgggaaattgtgttgaatcagtatataaatcctgtatactggtccttccatttcccctagaaataagtgatacaggccaggcgctgtggctcacacctgtaatcccagcactttgggaggcggaggctggcagatcacctgaggttgggagttcaagatcagcctgaccaacatggagaaacccccgtctctactaaaaatagaaaattagctgggcatggtggcacatgcctgtattcccagctactcgggaggctgaggcaggagaattgcttgaacccaagaggaggaggttgtggtgagccaagattatgccattgcactccagcctggggaacaagagtgaaactcaaaaaaaaaaaaaaaaagaaagaaaaagaaaaagaaagaaggaaggaaggaaggaaagaaagaaagaagtgatacaacaagttacagcatctttgtttattatccactgtgagttgtattaccacactttacttggctctttggcaaactatattatctcttcagatcactagggctaggaaggcccactggtaacttgaaggagtaaatgtatcttctaaaaaatgcttacttccagggagattggatccacacaagtgaatacatatatagtccttagtgtatgctatgattattttactatgtcagtagcataaagattgctatattaataagcattaagtgcctgctgtgctagacagtgaggatgcaagtggccaccaaaatagcatggtccctgccctcctggagcttctttttttcttcttcagtgggggaagcagatactttgcttatgcaaaaataattataaaatttaaagttgtgccaagttcaatggaaaaaatataaggtgttctgagagagcataacaaaggatcctggttttaactggggcctaatggaagacctctattaggaaataacatttaaactaagaccagacagacctgtagaaattagcaaagcaaagggagggaggaaaaagcagctttcctggcaaaggaacaatttgtgtgaaggccctgagacagggaagggctggggttctgaccaccctccaagtggtgcaatggaatatagtgagagagggagaagacatgagaacttggatactatgcaaaggatttggtattttaattcaagagcagtatgatgctactgaggagcagctggacaattgtgtgatccaattaaaattttaggaagatgaacctcgctattgtggagaatgcatacacaagggttctgttggttcatgaagaggtcttaagaaaactatgagctgggtgcagtagctcaggcctgtagtcccatctacttagaagtctgaggcgggaggatcccttgagcccaaggagctggaagttacagtgagctatgattattccactgtactccagcctggatgacagagcgagatcctgcctcagaaacaaaaaccaaaaaacaaacaacaacaaaaacaacaacaacgaaaatctcagaaaactacaggccttattatcaagaaaatgacaggccttattattgagaaaactacttacatttttaaaagctgattttcaaaaaccagattgtgaattaagtgatgctgaataggggaaaaaaagactgataaaccagtgtatctctgaataacccactagatcagtgcttgtcaaactttaatgtgttttcaaatcaccctgatgttttgttaaaatgtaagtcatgtctcagtaggtctagaggagggcatttctgcatttctaacaagctccccggtgatgcctagaccattggtcctcacactttgagtagcaagtgattgggctatactctttattctaaattctaaatgtattctatcttctaatgcctatcagccctcttgctggtctggctaattatcaaacttgagcatttaaaactgggggttttcagagattaattgaagtgttaaagacatggaaatataggtcacatatggcttttcatctcttccggaaatatcctatatatccttacttcttttctacctacctaacctatgtgcctaccccttcacttatgttcaaggttctattatacttcaaaaggactctatgcaatcaaagtgatgtccaagacaaatatacagaaatagtatgaggctctaacactttacatctaatggagtggtttgcatcattaattgaggcttactctgtgccaggcactttacctgccttcttcatttaataggataggagcaggaactcttagaggttcatttcttgttcaaggatatacatctcatctctggcttatatcacagtggactcttttattcactatcctaatcattataattttgtttggtgacaacaattctaaatgcagaaaagttaaggctctttattctgtgactaaaggctttgtattttctaaagatttgtggagctttgctgccattatttcaataattttataaagatcctaggtggtaaataggcctggctttttttctttttgaaatcttctccgtcttcttcttcattagcagtgcaacttcttgtggcatatggtacccaagatcttgggaaaaggattgatcaagtaaagggaaacgatagagagagtgtgctctacaactgagatcatgctccttgtgaaagacagggtagggaaatttcttattgctccctggttcttaagaaatgagagctaacaatgacatccagttttaaaagaaataaaatctgaattgtacttttaaattttataagccagagttaaaccaatagattgtaactcctgctaatttgatagtagctccagataatgaggaagtgacagggaatgctaatttcatttggtaagagataaaactgaaattattaatgtctccacggaaatgctaaatgcctccttacaagtagggtccggctaattgtctgtcttccaacaagccagatttgttggtgtttttccagacaatgttgtgtagttttcggtttggttcgatcccctttcttgtgatcaaagaaagtgattcaaatgtttaatgagtcttgatttggattggagacttgcagaacggctagcctcacagccccaaggctggctttccctaaggtaggtttcctatgcaccgatactggcaaggcgctttggctggaaactctggaaggaagccaaaggaaagtgaagttcctggcgctagcgcgtgtcctgctcagagagcccggcgctagctcattcttcgtgcagttattggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacaggtaaggtttagcaagtcatgcttgaccctgttagtgcttttttattcctacatcatattgaggaaggaatggagctgtttttttagtgatgaagatgttttcctggtgatgcattcacactttcaactggcccttcctagatcaaagttagtgcctttgtgagatggtggcctgccagagtgtggtttgtggtcccatttcagggggaagatacttgactcatctgtggacctaattcacatcctcagcactcttttgctatcacaactaaccaatcttgctaagggatggttaagctaaaacacaagatctcagcgatcagagtttagcttggtatcatttacattaggaataagctgctggatacctctaaccagtggcagcttctaggaatacaaaaactacctcattcctccacctttcaagtgattgtgacatttgtattaaaactaatagctttttgataattttcctttgtttatacagatcgtgtacctcattctcagataattttttatgaatgaaatgaaattccaggcatcctttaaattttatttcaagcattctactggaaatgatgtgcaccctgcttacaaaatatttttaccttataacagtaatgcatgtttgctagaaaattcagaaaatacagaaaagtatttaaaaaattaaaactataatctccaaacccaaagataaccatttttaattataaaagtaataatttatttcaaaaataaatctaggcaacccaagaaaacataaagtagccagactcagtggtgtgcacctgtagttcttgctgctcagtgcctgaggtgggaggattgcttgagcccaggagttctgggctgtggtgcactatgctgatcaattgatcaatccactgtctgcactaagttcagcatgaatacagtgacctcttgggagggcaggaccatcaggttgcctaaagaggggtgaactggcccaggttggaagtggagaaggtcaaaactgctgtgctatccagtagtgggatgacatctgtgaatagccactgcactccagcctaggcaatatagggaaaccatgtctctttaacaataacaacaacaacaacaacaatcccagaaactacaaaaggagagtctttttggtgcctccagtgttagtccctgtccttccagccttatttttcttaagtatatgcacaatgtgaaaggtagataaattcatatccttagacaggtaaagcattcattaattcagggtggtatgcaaggatactatccaaggcatggtatccatgcaaggtgactgcaaggcctttgccctggagagaaccctatacatactctcaactgtaggagaaacactgttattttgttactcagtgcatcattgctatcaactcttggatttggcagttagtcaaatgaggttctaccatttaccaactaggagtctgtggccaagttactcaatctcctttctaagcctcttcctcatatgcaaaaagggaataataagtgttttataagattcatgcatgatataatgtatgcaaagtgtttagcatggtgcctggcatatcataactgttaaacaattattagccagctcctagcattttgggaggctgaggcaggcggattgcttgaggccagcagttcaagaccagcctgagcgacatagtgagatcctgtctctacaaaaaaaaaaaaaaatgtgttttcattagctgggtgtgttggcatgcacctgtggtaccagctacttgggaggctgaagtgggagaattgcttgagcctgggaggttgaagctacagtcagctgtgattgcaccactacacttcaaccatggcaatagagtgagaccctgtctcaaaaaaaaaaattatcagctattactataattatttttattagttcctcactcacctaaaatctcaaacacaccttagaaatacacatatgagaacaaccaaaaatgacaaagtagaagcacatatgaaaaggctaagaaagcatgaaagccagcaagaaataactgccgctcttctggtcagcctggaaagcaactggcattttccctagaacaatgttttcaaacttggttgcacattaaaatcacctagagaccttttaaaaattctgaaacccaggccacaccccgacaaatgaaagcacagtctctgggggtgggacataggcatcattttttgaaggtccccacttgatcctaatgtgcagacaaatttgaaaaccacagctttgggaggctgaggtgggtggatcataagatcaggagtttgagaccagcctggccaatatggtgaaaccccgtctctactaaaaatgcaaacattagctgggcatggtggcgcatacctgtagtcccagctactctagaggctgaggcggaagcatcagtgagggagaatcagtgaacccaggatgtggaagtttcagtgagcccagatcacaccactgcactccagcctgggcgacagagcgagactccacctcaaaaacaaaaagaaagaaagaaaaaagaaaagcagtactctggaacctaccaatccatcatttagcatatttgtgaagtaaagtgttattctggtatttgcagaaccagaatccagctttattgggccaggcccaatttttttaaaaaacatggtaaggtctcccagccttaaagtattacatagcatagctctaaaagatcactgtaggaagacataaaatggtatttcagtcatctaagggaaaaaccttcctaaagcactagcccctggacaactattatttaaacatctacagctgttcaatagatattgggttctttttggagggatgtgacaaaattcttgtataattagattgtgatgatgattgtatcagtttagtacatgtaaatacactgaaaaccattggattatacactttaaatatgtgatttgcatggtatgtgaattatgtctcagtaaaaatctagagatggggctgggctcagtggctcacgcctgtaatcccagtacttagggaggctgaggccagcggatcacctgaggccaggagttcaagaccggcctggccaacatggtgaaacttcatctctactaataatacaaaaatcaggccgggcctggtggctcacgcctgtaatcccagcactttgggaggcggaggcgggcggatcacgaggtcaggagtccaagaccagcctggccaacatggtgaaaccccgtctctactaaaaatacaaaaattcaccaggcgtggtggctgaggcaggagaatcgcttgatggtggaggttgcagtgagccgagatcgcgccactgcactccagcctgggtgaaagagcgaaactccatctcaaaaaaaaaaaaaaaaaaaaaatcagccagatgtggtggcaggtgcctgtagtcacagctacttgggaggttgaagcaggagaatcgctttatctcaggaagcagaggttgcagtgagccaagatcatgctgttgcattccagcctgggcaacaagaacaaaactcactccatctcaaaaaaaaaaaaaaaatatctagagatgggagaatcatatggctggcataaaaaggtcaagtcaaagatatgtaagattaaggctttacgatgctccagttctagtaaaacagaccaggtacttgttttggtgtgaaattgccaatataagtatagtactgtacatattagttgtttagcttaggtaagtcttttaatctctttaaactccagtttcctcatctataaaataaagagaatatctactttgcaaacttgttgtgagagtgaaaagtaatgcatataaagtccctgtatggagcaagtactcaataactatttgttgaactaaaaatgataatactgatattcaccatttattagcatccctatgtgccagacactgtaaacaattaaaagttatcattctggtacccagagtacagtatgagacagacatgcaaaaaaaaaaaaaaaaaaagataatggagatctgcatagcataagatgcagtgggaccaaacgggaaaaaacacctaaatgagcctggagaaaggaagaaatgatagaggtggtgatgcttgagctatgatctaaaggttgagtagtagcttgtcagacagtaaaggggaaaggacagggcagggaggggccattgcaagaaattccatgcagagggattatggtatttcattatcactgaaccttaaactgtgtgtgtggccgggtacggtggctcatgcctgtaatcctagcactttgggaggccaaggtgggcagatcacttgaggtcaggagtttgaaaccagcctggccaacatggtgaaacctcatctctattaaaaatacaaaaaattagccaggtgtggttgtgggtgcctgtaattccagctacttgagcagctacttgagaggtcgaggcaggagaattgcttgaacccgggaggcagaggttgcaatgagctggtgtcaggccactgcactccagcatgggcaacagagagagactccatctcaaaaaaaaagtgtgcgtgtaaaacagacagtctttgtaggagatgaggtgaagcaagtaggcaggagttagatcctgagttacctttgggccaagccaaggagtttttattttattccatatagatgacagtcactgcagaaatttgaactgatatgcatatatcatgaggtttttttgttttagaaatattattctgtcagtcataagtgaagggactggggacattgggactggaggcaaagagatcttatctctttgcaatagtttgaaagctattgcaatatttgaagagaagattgataaatgcttgaaccagcacagtggcagtacagatggagggagctgactacaataaaatcatcaggacttgttgattgacatgatataggaagtgagggacagggatgagtcaaggctgatccccctagatcctgactaaggaagctgggtggttgacagtgccattcacagagacagtgaattctggcataaacacctaataggtcaggctggtttacacctccatcattcccatgggagaaggtatagaggggtgtgtgtttgtgtgtgtgtgtgtgtgtgtaaaagaacacagaaagccagattcctctttttgacaccagaatattggttcccaccatagtcaaaaggatattcctgaggatcgaggcttggaaaaatattggggaaggataagaactccagttgttgctgctttttttggcagccagtgtaacctaggtaaggacttggttgaattaagaaatttcatgtccagatcaggatggatttttctatttctctgagctctggtgtgtttcccactcagattgcaggtcgtaggtacctacggtgtgaattgtgttgtgtttctgtgcttgtgcaagggagtagctaggttgctgggaggtctggatgagggtgggggtggggtgagatcaagtctccagctccaagaggtcccctggggctaagtgaaaagcttgctcttttgaaatggtcttcgttggtaattaacaaaagatcaagaataccttggtgtcagataaagggaatttgtaggcacaatgctgttggtagctgatctcaatcattcaaggaagctattaaatctatgaacattagcattctgccaggtaaagagatctggtccttagcacctcccagacacactgattctttactgttttgaaacatctccctctcctggcttcctccaccccgcttccatactgtccttgaaatcaatgaatggtaatttagtgtatctagtgtatcactagcaaatgtctgaataagaaaggtttggtttccgctgtgtctcctgttacaatgagaacatgtactgcataaatttaattggctacgttaatgtgtaagccttttctgcaaagagatggatccgtttctgaatattctgcagaagggcagagttttgagtatatggcagtggttctaattagcagttgctccaatacaatcagactgagacggaagctactcatttagaatactggttgatgacaacactggcttgaacaaagtgaccactctccaatggctactctccctctcagtgggccgcaggttgctagggctcaggctgtggctgttttccccgccgaaaaggggcggggtcagtcggtgtgttaggaaaaaaaatgtatatatatatatatgttgtctgcctccccacagagataacaacccgtggaaaaacatgccgttgagcgggaggaaggcgaaaagataggctgggttttttggggggtgggggagcgtggaggatagggtgggctttttcccctccaatgctgcgacgcattaaccctgctgctgttgggacgttctctgctcagcctattggctgagcccgggagccgctgtctgccaatcgggtggtgaaaggcagacaaatctaccccgccaccagcaaaaacggcgcgtaacccttgcggcgccggccgaaccgcgccagagctggcgcggggaaagggagataggtgtctccagctgctgtggctgtttggggcgggtcggcttcatccgcgtctcaggagcaagtagagaattagcgggcggcagcaatgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagaggtgagacctttgcaggctcaacaaatgcttgagggttattctgatccaggcatatggctaggccatgtcctagagagtactggcctctcagtaagtgcccatagtgatgtcaccatttttgtaagaggtaactatgtggtagacgctgtgctttgtaactgtttcgtgaattaaccagagttgtcacagtttagcattgggggcgggtcatgcctatatctgagtaagaaatgaaagtaattggtgatcaagagccaggctgttgtggaagcatgatgatggaatgtgggagcacaggaggctacagtgcacagggtacagtgcaccaggcagtcacttggacaaaggtggctgttttctctactcttcctgaaagaggggatcagattctgaagtaccttaactctaggttaccatttcccaagggattgaggggaaataaaatctttgtctcccagtatctagtacactgtgaagggacctctctatttgaaacatagagacagcagaaagaggagagaactaaaggaatagagaggcacgcatcagagtggtggcatagatcttttggtctgggtcttaggactcatatcaagtccctactggggatttgaactagatgcggtaaattggaaggttggggcgggttggtcatcacctttggaaaaaacagtaagtgaaatcacttatgtcagaaaactggtttacagttggctgattcatagaaacagccaccctgtgcatctttaagttgagttctcctgaatttggtgaaaccatgaaacctagaagccaagccatccatgcttggcctctgaccaccctcctgggtgacctgattcagccccagaaatgttcccctacccaaaaactgtaacactcattccacatttggggtctggggtgtcagaaaagctaagtcccatgtcagctgacattgagatttccgcaaagcattgctggagagtcagggcaagactttacaaggttcttactaatcttttctctcaccttagcagcattcagcaggatgggggagggtgggggaatacatgggctttgcctctcccagaaggacaagattttgctggttcaagcaaagtggtggaagcttctgaagtcatgcaggaagttgctgggacagaacgctgaggagttttgtatcactttgtcttccctgttgagtaccatctgagctgtcaaactttgctgccaagggggctgaatcaacctgcagcacgaagtgagtggggaggtaggaagcttctgtgacacagatttgcagcctgtgttcccaaggtttccaggattgaggaaactccataattggttgagagcacacagactttttggccaatcagactcagagctgaggtgggagatctgctcttccagcccgcctctcctcctccagctccccagctccactcaaattcagctcccctcccccctgcccacccccgccactcggtgactaagaactgctgcaagcaggcaaacctccgagcagtttttaagaggctggaaggagacataagagacttcagctgctgcattccaagccctgggtctaccttggagacaggacagcacagacttactctccacaaagggacttctgggtcatggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagcgaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccaggtgaggggctcggcgccgccccgggcgacccctgggggcggcactggagaagccgcccgtcctcataagggattgaacttgcatccactcctctccggccggcttggtcgctggctgcgctccacccgattctcgggatcattggaccgtttgcgcgaaaccagagtggccgattaagggatggggctccgagcaccgggggtggtggcgactgtgggcgaggggaggtgggaccgacccccacccctacactcaaaaaaggccggggcctccttcgagcttccggtgaatttcgggcgatttccgcgggtgtcgggggtcccgggaggaggcagtcacagatccacccctgcagccagcctcctaggcgccggctccggcacgcttcgccggtctgtagatttcctcttcgatttctccccagctcccagcatctgtgacttcactgttaccctccctatccccgcatcacccaaccgcacctgtctgcgggacttaggtgtgcgcgcggggctcatgcgtgtcctccctgctggccacccccacggcccacacaagttgcacgggctcgccacgccccgccaacacgtgcgcggacgcacgcacgcactcctcgcacgtgggcttacgcgaataccagctttcactgccactcgctcgcggccagattcacaggcctgttccggtccactcgcagctcccctctgccgctccctccgccgggctcaggagtactcgtagctgattgtgcgcgcctgagggtcccagatcgcggccgcccaggaccaggcgaggactccggagcctcctctcacctctcccacctgcgccccgggctgggccgggtcgcctggggggcggcctgagcgaggcgcggggccaggagcgctggagcgactgccgctctaagtgccgggcgggcaggactctacgatccttgggccagaggtccggatggtcccgggactccgtctcaagggtcggcgacccctcaacccagaagcctcgagcaggcggacaggcagagctgcccagtggccgaggcgcggcagggctccgcgttgggcgagtgagtgagcctctataggacagcaggactgggactccagtggcaccagcggccccttcctcccgcaggaagtgaaagcctcgagcgccctggctctcaacccccagagatacaggcttttggcgccgtcgtgatcacaatgtgcccagcgatctagggtcagagatttggaggtgaccaaactatctgacactctaacaagtcctgtctcctctggcagatggaaagctataggctctgccagatgccagggtgcccttatgtgtgaggaaactacaatagtaaaaaacacaagtttctccaactccaggagcttttattcaaaatatatcaatgcctaactctgctcctaggactgtattttgaaacacccccaggtgattttgatagctgattgagagaaacttactatataactcctttgagaacctcatctcatttgctcttcccaccattgctgttggctaggtactaacatgcctctcttataacagcttcacagaggtcaagtgacttgctcaagttcacagagcaagtaagagagattctaacccctgtctaactccagaatgtgtgcttttaatttcttggcacttggaactttaaaagcttgaggacaggagaggggagttgcctctgctgggattttgcttctgctgggatggggcaagggtggggttccttcccttttaggaccttacatgtggggaaagtcttctgtggctcctcatttctgagcagtccccgcagcgcaaacttggccagttatccttttggagattgagttcccccagctccgtttcctcctatcacaatcactgcatttccatgtagattctgctgtgtctaagaatacagtggctgagggctggccatccctgtgcccttctccatggcagccccagaatggtgctggtgactcccgatacacctggaatgctaggtttctgggttctgctcatatcactgccacctgtgagccttgagtgagccactggcagttccggagcttccttctccctggagtaatctgagatactcacactctctgcttctgggagcaagtatgagtattaattaccagcccaccccagaaccagtgaggaggtggctctaggagtgctccatgagagtgtgtgatgggataacacaccccctggaaagaccagaagggactcaggaatgaagtggctggccagagccccacaccttcagctaggtgggagatggctacacatcagccccttgggagccctggagacttagttggccctgcttggaggctgtgggagctggatccctccccgctgcatcccttccatttttctccgtctcagacagagcagccttgttctcttctccttagtcacagaccattgtctggcacggagttctaggggtgagaagtgtcccgggacttggatgccccgcaaaggcccaatctggcatgactcctaaattaataatgtatttagctgtgggaagagattcttgcaagccaagggcccagagaagatgtccctgtgaatgtgtcactgcacaacctggcaccaaaagggttaccaagaacagcagccatcttgctgcagaggatgctttgttcccagctgaggagttgaataaattcattctagggctggtagaattctcattgaaaagcctcctttgccactttagggggctttgtctgcacctcttcccccagttccacagaagatgccttcagtccttgaattttggctcaggagttctgactctgggggcagggaggaaggggccatttctttaggaaaggagtctcagcttgctcactgtggtcagatgaaatgtgatttatctcttggtttctggtacctcagacctctgagacctgaggtgtattttgtctttggagatgagtccacccctgccccctcttagtccgttttcttctctgtgcccactcccctccttctctcccggcccatccctaggggctcgggtgacattctaacttctcacgggtactcagcccctttccctctgttttctccacagcaagccccgcccaacacggactggcgtttctctcaggcccagagacccggcaccagcgggtaggtgactgattctccagcccaccctcttctctgcggcattttctcagggatgacgtgggaggagatgggggagggcccagcatttgctacagatggcttctccctcagtttgagatcccagggaggtcttggtgtgcggggggctggcacacagaccccggaaggaagaggcgactgccctgactgttcaggaagctcaattcacatgcttgccccttccctcctcgccacgaccggcaccttttcctatcccctgagggcactgtggaaccaaaggatggtcttaagctggtctctgggtgaaagcgaggctttctatgcccatgtactgcctaaccccctcccctgagttgagctgggctccattatgacctggggctcaggcagaaaagcatttgaccggaggaggcggtccgcactcagcgcctcctccagagcctccagagccgaggctgactgcagcctggggagagtggaggcagcacagctggaggtggaactgaggaaggactgggcggggcatggagcaggcccccttctccggcccctcctcccactgtcctctgcccctacttgtcctgctctctgtctgtggggtctccgtgtctctgcccctttttcttgagtttccgtctttgccactttctcttacctctcagtccttccctcagtctctatctcgctttgcaatctctgcctctccctctcttctccatctctgtcttagcttccgtcttgattgctgcacctcagcctcagtccctttcatttgtctacttgcattgatctgtgccgcccactgtgcctgccatggcataagtgctcaataaatgtggagtgagtaactacacgggacccttagtctctttctccttctctatctctgcctccctgtccttgtcctggacctcttttctgtttctcctttcaccgtttcctagcgccttgtgttcttctatccccagcctctatgtttctctgtctctcactatttctgctttcctctctgttctttgtctctctttgtctctgtctctgtatatctttctttgtctctgtctctggtctctgtgcctgttgtctttttctgcctctttctctgttactctttctttatctctctttttcttttatcttgtcttttttctctgagcctctgtctctgtctctcatttttttgtgcttgtgggcaagccagcacacacaaccccccacccaccacccaccaacaccccgctctcttccttccctgcccctcacacactgagcctttgatcgcagctctccaccagacaccctcccatccaagcagccccagctgctcatttcaatctggtatgaattcctgctgagacaggaaccccctgcgggctgaaggggagggaaacttcagcagaaagaccttcagttggtctgagcagagtgggataggctctgcgccaggcctcccagttagaagtcaggagcctggaggagtctcagagcccagggagagaagcaggagcttgggccaccttaccctacctcctcaatggttgagtacttgctgtccacatttgccaagttgctacagatgctgagcttccaagagttatctttcccccatcctgcaaccaaccaaacccttgttgccacaaggacccaggagcccttggtgtatggcagagattccagcttctgggcatgcacagtcctgtcacccattttaggaacgcaaagcgcttcttagaaggcccctaaaaagcagcagatcaaaaggcttgggctgcccttgcccttcctttgaccccagctgttgtccttctccctgctggccttgccaaccttctcataagttatccattaagtcattaatgtattcattcgttcatttattcaacaaatatttatcgagcatctactatgagcagggccctgtgctaaacattgggctataggagtgaacaagtagatgtgatcccagaactcataggcttccagaccagcagaggagactgaaaatttgcaacaagtaacacttaaaaaaaaaaaaaaaggctgggcactgtggttcacgcctgtaatcccagcactttgggaggccaaggtgggtagatcacttgaggtcaggggtttgagaccagcctggcagccaacatggtgaaaccccatctcgattaaaaatacaaaaattagccaggcgtggtggcaggcacctgtaatcccagcgacttaggaggctgaggcagaactgcttgaacccggaaggcagaggttgcagtgagctgagatcacgaaaaaaaaataatctagccacaaatcacagtaagttctgagaggcagagaacaatgtgagtgtaatgggggggggaagatcagagaaggcttctaggaggaggtgacattgagaagttctaggccatttatgttccctctacctaccaccaccccaggccatacactggctttgaagcagaattcaccattgaacctggaagccccaccaactgcctctcatgtgtcctctggggtgagcaccttacccctgcctcaactcccattccatcaaatgagaggcttagtggcctggaatacatgtgggagctcttggagatatggaggagaaggtgcggaacctctctctctctcctctctctgcttccttagttaacttgtggaggatgcaacaaaccttttttttttttttttttagacagagtcttgctctgttgcccaagctggagtgcagtggtgcgatcttggctcactgcaacctctgcctgccaggttcaagcgattctcctgcctcagcctcccgagtagctgggacagcaggtgtgcaccaccacacccagctcatttttgtatttttagtagagatgggtttcgccacgttggccaggctggtttcaaactccccgacctcaactgatccacctgcttcagcttcccaaagtgctagaattacaggtgtgatcgcccccggccacaacaaacatttttgattcagcggctccaaagtgaaataagcgttaggatctagtccagtaacttcaacttctctccttcattcattcaacaaatggtcagtgagcactttctgttggccaggcagtgttctcgatgtgggaggcccctgccctcaaggagtttacagtgcactgaaggagacaaatattgaccaaataattacaaaaataaatgtgagactgaaactgtcataagtgctaggtagaattgtatctggtggtgtgggcgtataatagggatttgatttagggagcaggaggacatcctggaaatgaagttgtgctgagatctgaaagacaaatacaaattaaccagctaaagaaaagaaggaagagcattccagatggtcaggcataccagcttcaaagcagggctggtgttgagttcttcagtaaacttggttcaagatcaagccagctctgggtcacactgcctacacagaaggaagagcattccaaatgggaaaagcctatgcaaaagccttgtggtgaggcctcctgggatcaagggaatggcagggagttttctctttgctggcactggagtgaggggatgaagaggagaggttccttttatccagtctaaccctggttccagccttctgttgatgccctgcctcactccctccccaccatcttgcccactgccctccagcctggtctggtcagacacaccagcttcaaagcagggctagtattgagttcttcagtaaacttggttcaagttcaagtcagcactgggtcacactgcctagacagaaggaagaagacctggccaggtgtggtggctcacgcctgtaatcccagcactttgggaggctgaggtgggtggatcacctgaggtcaggagtttgagaccagcctggccaacatgatgaaaccccatctctagtaaaaatacaaaatattagccaggtgtggtggtgcacacctgtagtcccagctactcaggaggctgaggcaggggaatcgcttgaacccaggaggcggaggttgcagtgagctgagatcacaccactgcactccagtctgggtgacagagcgagactccatcaggaaagaaagaaagaaaaagagagagagggagggagggagggaaggaaggaaggaaggaaggaaggaaggaaggaaggaaggaaggaaggaaggaagaaaagaaagaaaaagggagaaaaaatgaagaagacttacattctgaagttcctgcttggcacatgcttctcctccccaccactatcccttctcaggtcatcctttgggtgtctgatcccaatagctgttgtctcaagctctgagcccagcaaaccatttcccccttcttaggctgtaacccaggccctgccctgcagctgtccccagcctctgcacaaagagtctccatttggtccctagactgttctctgatggctccacactaccatccctcctctgagagacagtatccctgctctctctcagtttgggcagtcattcaacaaacaaatagcaacttaatttttttccacttataaaatagtacatgctcattatagaaacatgaaaaatagaaaaaaaattaaaaggaaaaccacccatcattttacaatctagggagaaccaccaccaactacagtttaatatgaaacatttcaaatatgtacaaaagtagagagaatggtgtcatgaacctgtatgataccactatccagcttcaactaatgccttatcttgtttcacctatatccctacccttatcctgtccttggattcttttgaagcaaatctcagacatcatataatttcatcttggtctccaccatctttaacagatgacttttttttttttttttttttttggagacagagtctcactctcttgcccaggctgtggcacaatctcagctcactgcagccttcgcctcccgggttcaagcaattctcatgcttcagcctcctaagtagctaggattacaggtgtgcaccaccacacacagctaatattttgtattttcagtacaaacagggtttcgccatgttggccaggctggtcttgaactcctggcctcaagtgatccaccctcctcggcctcccaaaatgttgggattacaggtgtgagccaccttgcccggccagatgattctttcataaggtccacattttatatttgagtgagtgtctcttaagtatcttaatgctcttttaatgtaaaagacttcccctccatcttccatttttgcaatttatttgttgaatccctgccttttcatatatatctttctaaacttttctttgtgtaatcaaagaacatgcatgagcttcatttttatttttatttatttatttatttatttatttatttatttatttattgatacgtagccttgctctgtcacccaggctggactgcagtggcgcaatctcggctcactgcaagctccgcctcccaggttcacgccatgctcctgcctcagcctccagaatagctgggactacaggcgcccactaccacgcccggctaattattttgtatttttagtagagacggggtttcaccgtgttagccaggatggtctcgatctcctgacctcgtgatccgcccgcctcggcctcccaaagtgctgggattacaggcgtgagccaccgcgcctggccgagcttcattttaaaaaaatctcattcacctaaataagttgttcacaaacttgtcacactttcatgtgacactttattcacatattaagaactgttattcccagtcatacggtacatttcctactagttttttaaaaatagcaactgaggccatactgtccaacagaattatagcttttttcttctttgcagtgtatcatgagaatttccccatgtctttcaaaattcttcccaagtcatttgcagagtaactcctcttatgaatatacatattattttacagaataagtcctcatatgaatatacatattatttttctaatgctaatgggcttttgctacattagaaaacatacacattcatttacaattttttttttttgagacagtctcgctctgtctccaggctggggtgcagtggcgccatctcggctcactgcaagctccacctcctgggttcaagcaattctcctgcctcagcctcctgagtagctgggactacaggcacgcgccaccacgcccagctaatttttgtatttttagtagagacggggtttcaccatgttgaccaggatggtctcaatctcttgacctcgtgatccgcctgcctcagcctccctaagtgctgggattacaggtgggagccaccatccccagcctcatttacattttaacacaattaaattcagggtgttgtcagggtgacttcctagatttctcagttttttgagcatgatgtagggagtattttattatagtccagtctatgggatattcccttatacacacacacacacacacacacacacacacacacacacacacaccccaaactcaatagggcaagaaccatattcatcatctcttaaatcctaggtcctgtcacaggccactgcttggaaaatagttgactaaatgtagtccatttcttccatttttacttttcactattccccaaatcctggaagagtccctcatatctgctgctggggctccaaggcctccaagctgaagcccagtacgttgttgtgcataagatcataggccctggaatcatattaggctggctttcaggttgcaactctaccagttccagctgtgtgactctggtatagtctctcaacctctctgagccctgttttcatctgttggaaaatatagataatcacaacacttatctgcagggtgattccgaggataaaaaagacaaatatattacccagtcagcttagaataggaagctctcagtaaatggttaaaaaagaggtctctctccctctgctcatctcttacccagcttcacataattggcagcccacccacctgtttggccctcaaccttcaaccatttcccaggacgcctccttacactcctgatcatcatggttccaaccccactgttccactcagctttgttccctcaacaccactgctccctgtgacaggtcatcctcctaacctctggcatctggtcccgttgtctccctgacaacccgcatgctctcctccctgcaacccccgccgcttgcctgctctccctactttattcccattagcccccttcacctggggctgagaacacctggccttgaccctgcaccctcagccaggcccacagagctcagtcgggccggaagtaaggaccccagatattcagttgaggaatttaacattaatacaataatatagaatccaccagcagattttcataaatgttctgtgtgttcttttatccttttttttaatccaggattttatcaaggagcatagattgcatttggttgtcacgtctttcctctcctttaatctggagccagctcccagtctttttatttttttaatgacatggatatttttaaagagtccaggccagttgtactttaaaatgtccccgaacctggatttgctggctattctctgatggttagattcagattacacaccttggtaggaatacttcccgcagcatcacactgggactcatctaacgtcggcctgtcccactatcagtgatgccgagtttgttcgtgtggtaaaaacagtgtcccagatctctccattataaaaatatatttttataaagatattttaaaatatttgtgaaaatataagtaatctgtggatgatactttgagataggcagcaacccttcatgcaattttagtattccctgatgatccttgcctgtatctgtttttacatcagtgattacaaagcggtgatgttctgtcattccttctacatgtatttgctggtattcttctgaaaattacctggatgatttcttcagatttaaattcactgtcttttccttggggaagcctggactggctgagctgcctaaccctgactctctgtcttttttttttttttgacagggagtctagctctgttgccaggctggagtgcagtggcaaccttcacctcctgggttcaagcgattctcctgcctcagcctcccaagtagctgggattacaggcgtgtgccaccatgcccggttaattttttttttttaatatctattttagttgagacagggtttcaccatgttggtcagaatggtctcgatctcctgacctcgtggtctgcccgcccctgcctctcttcataccctctggtagcccctgacacagcccatggcaagtatcacaattgcaattactctattgtgtaattatttaaaatcagcctctcagtgcccaccatgagcaccgtaaagatggacagtttctatcatactcacagccacaaccccagcacctggctctgtgtctggtacatagaaattgctcaagaaagaattgttggaggggcgcggtggctcacgcctgtaattccagcactttgggaagcggaggcaggtggatcatgaggtcaggagttcgaaaccaacctggccaatatggtgaaaccccatctctactaaaaatacaaaaattcgctgggcatggtggcatgtgtgcacttgtcgtcccagctgctcaagaggctgaggcaggagaatcacttgaacctgggaggcagaggttgcagtgagccgagatcgcgccactgtactccagcctgggtgacagagcgagactccagctcaaaaaaaaaaaaaaaagaaaaaagaaaagaaataattattgaatcaatggaaacagaattacaactcttcccacttttgggaaggagaattgagattcctgctttccccttcaaccctagctttatgtttgttgtgatggtatagaggtcacacatggcagccttgtgtctgttcttaggctgagttcatctacttagggacggggaatcccagattgggcaaaaccaaaagcagggacagaccttggaaaaattgtaaagcagttcttggttgtgctcacccaccatgacaaaatatgcacacacacaacgcaacacacacacagacattttcatgccttcaaggcctaccctacagcctttcccatggtgccaaacccttcttcttaccttacagtcacttaactgtctctgctggtctcttcccactcatttaggcaacaaatatttattgaaaaacttctctgagccagatggtgccaaacagttacctaaagggcagactgtgtgtgtgccagggctgtttcccgccaacactcccctgcaaattgaaataatttcatccttggaaattcaaaaaaatcatgaaaattgtcactgtgggaaaattccaagtagagctgaaccttctaagaagcagagagttcttcttatggtttagtatttttttaaattatgaatcatttcatgttttttcaacactcggagtttctaaaagtctcacttaggtccaagtgctaggctttgtgctaggtgcttcagtaggaagcaggtggagtcgctgcctcacagaagccagtgtggtggaggaacagacaggcactacaacagctgcagtgtgactagtgccatgtggggcagccgctgggatgggagtacagtggaggcacctgcccagtctgagtggatctcctctgatatattttattcgtgtcatcatggcaaatgttgggggactggcattctagggaacaccatctgcccaggattcacagcaagagggaacttgagggataggaaagtgcaccttggaaaaggtttgatgatagagtgtttgagggcggggggtgggggttcttgtaaaataggaggggcaggttcttctatggccgtggattttactctgagggcttaggaagccattgaattttagaaatttcttctccctgctccagggtctcttggggcctcctacatctccccctaggtacctcctaggtccccactttttctctagctctggaacattctcttccatttcccaccttcacagtcctctggagaaggtctgatctccctcactatgacaggaagccaggctctctcatggtgggtgggggaatgcactatgttcaatgcattggaccagcctggccaacatggtgaaaccccgtctgtactaaaaatacaaaaattagcctggcacagtggcaggtgcctgtcatcccagctacttgggagactgaggcaggagaatcgcttgaacccaggaggtggatgttgcaatgagccaagatcgcgccactgcactccagcctggatgacagagtaagaccctgtctaaaacaaaaagaaaaaagcatcggaggcagcaaagagctggtttgagggactgacttgtgggattctggcttctgaaggattgtagaagtgcctcctaccttgctgagagaaacaggtcttgggcatggggtagggttagggtactaggtttgggagccctgggagaggacaggaggggcatgagctgtgccggcctgggagtctgtgctcaccatcctactctctccccagctcccaaaatggcgatgacaccggcacctggcccaacaaccagtttgacacagagatgctgcaagccatgatcttggcgtccgccagtggtaagtggtgtcagtgtgtgtatggaagagtgggagacctggggttctggggtgcatctcacagccaccatgcccacggactggatgtcaaacctgtgtagtttctccagatctttcggcaggtctgaaaggacccacaattccaaacataaagcctggaattgtggctaaggaacagcagaggggttgggggtcctgggatgcctggaggagagcgaacaaggaaaagactcatggagggaatagtggttacaagtctagctctggaatgggacagtgtagctcaggtcctagctctgctactatccttgggacttggatcgacttgctcaatctctctaaacctcagtttcctcagcctagaaagtggggacagggaccccaaagggttgttgtagagattaaatgagatgataccacaaagcatagagttctgggcctggcgcttggaagccctcaagcaatgaaagtgggtgtagaaatccccagccgagagaacacctcctctttatgcgaggctcctcttttgctgcccctaactccagagtaggattctggttttcccataaggttgactaagggcttcctttgtaatagagattcggctagtggtggttgtccctgaagagtcactagggcccagagcaggagaagaagaatatcatttgtccttaagagcacagcctaagctgggcgtggtggctcacgcctgtaatcccagcactttgggaagctgaggcaggaggatcatgaggtcaggagttcgaaaccggcctggccaacatagtgaaaccctgtctctactaaaaatacaaaaattagctgggcatggtggtgcgtgcctgtagtcccagctacttgggaggctgaggcaggagaatcgcttgaacctgggaggtggctgtggtgagcagaaaatcgcaccactgcactccagcctgggcaacagtctcgctctgtctcaaaaaaaaaaaaaaaaaaaaagagcacaggctttagaggcaggccaatctggattcaaatcctggcacctggcaccaccacttagcaatgagtccttaggtaagttattaaaccccctcggtttcacttactattaatgggcacagtattaacggatctcattgtggtgttaccagggccaaatgcaagtccctcagcacaggattggcagagagtaagggcacaatatattattatctttgctgacccaaacccgttttttactgggtagaaagcagaattagaataatgcctattaataaagactagcttctggagcagcaaatcctgggcttataaggaggctggcagaggatcaaggcattgccctatatcatgaactgatagccctgccctccagcatgtctggaggactggtgggtagagaaccaggtgaaatcacaagaagcactgtcatcacacctgggcacatactaaacaaactttaggggcctcctgtcaatgaatcctctcaatagctctgcaaggcaggtctgatttctcacactcgacagatgagagaaccgagaaggcacttgccccagggtcctcagttttgagctgccaagctgaggttctaacctggctcaactcctaagtttatgctctttctactatagggaccatggctgcctttggatccagcctcggcttctctattacctgagcaggatgagaggctgtcctcttcctcgagctctgctttattcttccagatcagggttgccagataaaatacaggatgcccagttacagttgaatgtcagataaacagcaagtactatttcagcataagtcagtctcaaatgttgcatgagacataatgtactaaaaaaaaaaatgctcattgtttacctgaaattcaaatttaactgggagccctgtacttttatttactaaatctggcaactctaccccagatgtctgtgaggttaagtggggccaggcctacagctgacggaaggacagagagagaggtggcagggactgctggcctcctgaggcagagctgtcccaggtctggtggggctatgattccagagaggccagagactgagtatgaaagtggcaggcggctgggtctgaggagatgccaagttggcctcttgagggaaataaacaggtatatttagctgttgtggccttgcgccctgaggccaggaagcagctttttagcctaaatccagatgttaaaaacagaaatgaaatcagtatttatggccccaaaccctccaagcaagtcatgcagctcgttcccctgtcaaggcctcccacctttggcccacacagggcctgaccctcgtctaagcctgcgccctggggaacggaccctgggggtggaggtggtgggtcaggccctgctctcactttcacacccgcttcctagccctgaaaccagagaggttcctgaagtccagcccagccaggcctgtggggctgctgagaggggttaagtaagagggagagtaaaaaccgacacttgggaggaggcttttaaaataaacatctgcggggagggatgctctcaaggaggctgcggtttgcagctcagccagctgtgttccagctaatcagcctccttgggctactctggagttgctgccttggccctgggatggggtaggttaagaggacagagggaggtcagggagctgggggctgagtttccctgagtagaggctggcacaggagagaaggcatcacccccacctcgtccaggccagaagatgtccagcttcttgaggctctcctaagtctgcctctcctgggaccaagagaaaatcccggtccttgaccaaggtgggccttggggggagtggggtgtagagggaggggcactggagaactgactctacagaaagtcaaagctggcaatccaacttcttcccctcagatttatagatgggaaaacaggcttgagccacgcagagacttgaccaagctcacacagttccttagtggcagagcagagcaaatattctctttcttttacattctggatttccatatcttctctccctcctggtccagcccaacctcagggcaccccccacgaggtgggcgggggatggctttgtcacttgcacccactcggggtgctactcagagatcttgggtgcacataggacgtgggtgggccgagcttctagctactccgtcaggcccttcctgtcattctgtctctgcctcccttctccctgcttctccgtgttcctcctcattcttttctgtgtgcagggagactacaccccccaccccgctctttctctggcgcctctgaggtcccccctctagcccctaaatcactctggaatcctggctctttgaagccagatctgggcccccctcccctaccccttccattcccaggctgggaaaggctgaagaggctgacggctggaggggagggggcggggcggtggcggatctggcttccttttggagttaattagggaaaacagagaaatgtcagcggaatgaaagggctgggggtgggggccagctggggtaggagaggaggaagtgggcagctgctccctcccactcaacccctctcccccgcccccagaaagctctcagctccggggatttgcgacatgaaatgggggctgtagaaacctgagcgctggtgcgtgaagagaaaaaccgaggcgcatcccggctctcccctcccgtgtgccctcctcctcttatgccggcttgaaaatatttcctgtctctctatttctcaatccctggttgatgtcccaggattactcagcctctccggctttagtcactctcgctacccgctcccagggtccagggtggaggcagagggaggctgggagagaagctctactgccagctgggcctgggctggcctgggcatccctgaggttttaactgtctcctaaccacagaggatctcagggcctccagcagcgagccccaatgagtcaaactcttgtttcctcctctcccacccccgacccagtcagggcaggtgaggggtagaggtgatggcatgctggatgtgacggtgttgatgatgtattgcacaggatgaagcaccatctcatttagtcctcacagcagccttcacagtgcgtacaaatcagctggcaattccgagaggctgcattctaaacaagttcctgggtgatgctgagccagggccagagtgtggacttctctgggccccagtttcttcttctgtacagtgggacgttggactggaggtgctgtctgatgtcacctagctgtggcactctgagcctgtgcctaaagtgtccctgagatgtctagtccccgagatcatcatctcctcagcttcatagagccgagctcttctccatcttctctctacctcccattcactcagaacagggataaggtccaagctgctggtggtgatggtgactgactgtcccttccagcatgcgcttaggtacacttgggcctgaatgcccctctaacaaatgctaccgggtatggccttggtccttctaacacttggttccctcatctgtaaaatgagggtcataccacatagctggctgggctgttatgtagaggttaaaagtgattgtgcatgtgaagcatccagcagagtgcctggcacacagtaggtgctcaaatgctgttttgaaatacaaaaattagctgggctagtggtgtgcacctgtaatctcagctactcaggaggttgaggcaggagaatcacttgagcccaggaggcagaggttgcagtgagccgggatcgcgccactgcactccaggctgggcgacagagcaggactccatcttaaaaaaaaaaaaaaaaaaatgctgttttgaaatggaggcttggaagagcactcttcacccccaccccacacacttactaacggaactaccgaatctctactcgtgccaggccttgcttggcaaaggctaggggcatgtaaagccatggtttcatggctgctgccctccaggagcccatggtctagtgtgggagtcagaggctcccttgagaaagccagggcaaggaactgagagcccgtgtcacagccctgagagaaataccagcgaatgtgttttgagcacttacatctaccaggcactattttacgtacctgacatacattttcttatttagcattcactaaaaccagaagaggtggttaccattatcatccccattttgcagatgagaaaactgaagtggcataaggaggttaggtagacttgcccaggatcacagtgagtaaggaaaggagctaggaatcaaacctagactttctcactccagagcctcttaacctctaccctcaactcttgtgaagagagactaccttggtgacccctatattcccagtgctcagcgtggtcaaggcccagggtgctgtataggcattcattaactgctggggatataagacagtgactgttgaggaccctaagtttagctcccacctgatcttcctctgtctctgcagaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctgaa

SEQ ID NO: 218 - DNA, 11915 bp, Homo sapiens
  C21orf57
gcgcgcggagctgcgtgggggaaggaaacggcgcccctggcgccggcccagcccccacgctcaccgtctcgccccaggaccccgaggcccgcgctgcccactggcccctcggaaagacttgaggcgcaagcacaggctgctgccgcgacactcagcgctgcgcaccgcgggcagaaaacgccgcggaccgacttccggttcgctcagcactaccggattccgccccgcccgctgcgatccggttccgctccccacaacccgctctgtggcggggcttccggtcgggagggtccgcccgctctcgcgtcctttgctgggtccagacaccggtacgtccgggcgggtttttagtctcccaagcgagagcgtcgcattcacccgcgtgggtctgcgggcgccccagaccccagaggacccggcccccaacgcttacctgtcccctctcctgtccctcccccattccagccccttctctccccagccgttgcccctccccgcaccccgccgcgtccgcgcgcctctctccgcgcgcacccccaacccgcccccttttctctgggaaccgctccttccgctccgcccgcctggagtccttctggccggattccgcggcatccttccatagaccctcgttgttgcttcctccttgtggtaaatgtaaattcccttaagattttcaatcagttccaccaaataaagtgatctgattgcgcgtgcatctgtatttttacagaccgtattatcacttgtactgattggtcttctcttacactttaaccccaggttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgaggtaaaaaaaaaatgttcctcttcttgtctagcccatcttcccagagtaaatttcctgtcgttttgttttgttttgttttgttttttaattgagacggagtcttgctctgtcacccaggctggagtgcagtggtgcgatctcggctcactgcaacctcccttcctggttcaagtgattcttttgcctcagcctccccagtaggtgggaccacagatgctggccaccacgcctggctaatttttttttgtcagtatttttagtagagacgggggttttaccatgttggccaggctgctcctgaactgatctcaggtgatctgcctgcctcgggcttcccagagtgttgggattacaggcgtgagccagagcacccggcctaaatttcatgtattaattatattataggctaggctccatggtgcctataagtatatatgttacagacatgatttttaattttaattttgaaaattttcaaatatacacaaaagtagagagagcagtatattcagcctccactgatcgaggcccatcacccagagtctacaattacactggtaacccagcaggaaaaagaaaggtgacagccgagcgcgatggctcatacccataatcccagcactttgggagcccgaggcgggtggttcacctgaggtcaggagttcgagatcagcctggccaacatggtgaaaccctgcctctactaaaaacacaaagaattagctgggtgtggttgtgccgggcgggaggtggaggggggcacctataatcctagctacctgggaggctgaggcaggagaatcgcttgaaccccagagatggaggttgcagtgagctgagatcacaccattgcactccagcctgggcaagaagagcgaaactctgtctcaggaaaaaaaaaagaaaagaaaaaggtgactagcgtccaccccccttcccctcctaatgctctcagtgaattagaagagagaagcaaactgcttctgcaatatttttgcagttttaagtgggattcgttaatgaatatgtgcacattggaaaaattaaaacaacactgaaaataaacagactggggtaaatatttccaacaaactcaatgtaatagcagtcaggttattatctacattctgtagatgacttcattcaaggcttcccacattgtagcagcaggaattggagcaatcctttgggaaagcaacttggcatttcaaacacatgtatcctttagtcctgtggtgacacacccaagacaataaaccaaaaggcagaagaggccgggtgcagtggctcacgcctgtaatcccagcactttgggaggccgaggtgggtggatcacgatgtcaggaattcaagaccatcctggccaacatggtgaaaccccgtctctactaaaaatacaaaaaaagttagctgggtgtggtggcatttgcctgtaatcccagctactcgggaggctgaggcaggaaaatctcttgaaccaggaagtcggaggttgcagtgagctgagattgcaccactgcactccagcctggcgacagagcgagactccgtctcaaaaagaaaaaaaaaaaaagaagaaaagaaaatgctgaatcacgtaaaaatgtattgaaatgttaatttattggctgggcctataatcccagcactttgggaagctaaggtgggaggatcacttgagcccaggagttcaagaccagtctgggcaacatggtcaaaccttgtttctacaaaaaataaaaacaacaattagccgggcatggtggtgtgcagagctgtcgtcccagctactcaggaggctaaggtgagaggatcgcctgagctcaagaaactgaggctgcagtgagccaagactgcacctctgcactccaccctgggccacagagtaacaccctttttcaaaaaaaaagttaccattttctgtaataggaaaataagaggagcatcctaaatatccagccataggtgactggcttagtgtgaacagtccttaactaagtggactggtctttatagtctttatgtggaaaatgtgaaagactctttaggacaaaataccaagtggaaagaacaggaatatacagtcgtgtccatgtgatgatttaactctgtagaagttgtggatctgcgtgattctgcattgggagggatgaaagaaatgaaaagccatttgacaaggtgatagcaacctaaacaaacaggcttttaaagaaaaggatgtttatttgggatagagcattgcagtgaaaatacatgccacatgccatagtagactgtgtggatattcgcatattcagggaggtaaaggaaggcaagggttttgtttttttttttttttttgagacggaggcttgctctgtcacccaggctggagtgcaatggcacaatctcggctcactgcaacctccacctctcaggtccaagcgattctcctgcttcagcctcccgagtagctgggattacaggcgcccaccaccacatctggctaatttttttttttttgtatttttagtaaagttggggtttcaccatgttggccaagctggtctagaactcctgacctcaggtgatctacccgcctctgccttccaaagtgctgggattacaggcgtgagccactgagccccgcctggcaaaggtttttaaaggaaaaaaacataattgttttgagataatgatccttggttgcaaagatcaataacaagattaatgtccgtccaaggttagacaggcagttgctgggcagattatccttgcagaagtttctgtgtgcgtgtaaggttgtcatagcctttgtgcaaggttgcagttttgtgtgtgtgtaaggttgtcatagcctttgtgcaaggttgcagtttcgtgtgtgtgtgtaaggttgtcatagcctttgtgcaaggttgcagttttgtatgtgtgtaaggttgtcatagcctttgttgcagtttttgccatctttagtgacagtttttgttatcaggcatggaagtatgagaatcctctcttcatagctttccccagctctatttgtcaggttttttggtttgtttgtataaccctaatggctccatttttattctgacaaattcctttttttttttgagacggagtcttgctctgtcagccaggctgaagtgcaatggcgcagtctaggggctcactgcaacctccgcctcccaggttcaagcgattctcctgcctcagcctcccgagtagctggggttacaggcatgtgccatcacacctggctaatttttgtatttttagtagagatggggtttcaccatgttggtcaggctggtgtcaaacccctgacctcttgatctgcccgcctcggcctcccaaagtgctgggattacagctgtgagccaccacgcctggctattctgacaattttcacaatggaaacaatttagggcacttgtgtacggttggctgggcaacccacccgccacaggcccagctgccactctggcctgagacatgcatcttaagagtgatttgggtggctggcacagtggctcacgcctgtaatcccagcactctgggaggctgaggcaggcagatcacctgaggtcaggagttcgagaccagcctgacccatatgatgaaaccccatctctactaaaaaatacaaaaattaggccagacgcggtggctcacgcctgtaatcccagcactttcggaggccaaggcgggtggatcacctgaggttgggagtttgagaccagcctgaccaacacggagaaacccagtctctactaaaaatacaaaattagccgggcgtggtggcgcatgcctgtagtcccagctactcgggaggctgaggcaggagaattgcttgaacccaggaggcggacactccagcctgggcaacaagagggaaactctgtctcaggaaaaaaaaaaaaaaaagaaatacaaaaattagctgggcacggtggcatgcacctgtaatcccagctactcaggaggctgagacaggagaatcacttgaacccgggaggcagaggttgcagtgagccgagatcgcgccattccactgcagcctgggcaacaagagtgaaactccgtctcaaaaaaaaaaaaaaaaaaagtgatttggctcagagataagtgcttatttgccttgggattaaccaggatgaaacctgtcaacctgtggttgggttacgtttcctgttctctaagtctacatttcctcattttttagcatctgaaagcaggtgaatttccccagcctgattttccagatgactacaatttgggagacattttcctaggagtggagtatatcttccatcagtgtaaagaaaatgaagattacaatgacgtcctgactgtaagcggggatgctgaaatcatataacctggctcatggaacatgggccttgcaaaggggtcaagatcacaaccctgcatccatgtgtgtccgtgggtaccgtaagggctactgggggaagaacctgtaagcagggtgtgaggagcacccaggctgggtagggactgcatgccccatgccacagttgaaggagggagagaacacgctgtgaaaacacagaagctcccagagaagccttctcagcttttatctctggagtagagcagactatgttgagctaacacagacctgctgaatcagcttctttctgagctgccagaagtacagaagttggagcctccaccaccttccagatctgtttctcctcagtgtaatccacctatgggttcttcctgcccactgcacagacaaaaccaattcactgcaattgtggtattgcagtagagaaagagtttaacacagagctagccaagcagaaaggctggagttattattcaactcaatctcccagagaactcagaggctacagtttctacaggcaatttggcaggcaggggctagggaatgcctgctgctgatcggctgcagacggaccatggggtgtcaacgatttttgtcccctgagtccgcctctgcgtggagccacgggatcagctgagtcatgagtctcaggtccaggtggagtctgtaggttgccagaactcaaaagtctgaaaaacatcccaaaagaccattcttaggttgtactattgacgttatcttattggggagcaattggggcggtcacaaatctcgtgacctctggctgcgtgagtcctgagcagtagggaattacagcagggcaagctggggaagcaaggcctgcgggctggttctcctcaggacacctacatctgagcagaattcaggcccctcccatcatcctaatcttgtggcccttcacaagcttcacagaggtggcttcggtcttgagcaaggaggggattcgttttagggagggatgattactattcttgatttaaagttaaactctagattaaattcctcccgtggttagcttggcctgtgcccgggactgagtggggacagccacgcaagttaaactctagattaaattcctcccgcggttagcctgacccgtgcccgggactcagtggggacagccacgcaagttaaactctagattaaattcctcccgcggttagcctgacccgtgcccgggactcagtggggacagccacgcaagttagactctagattaaattcctcccgcggttagcctgacccgtgcccgggactcagtggagtcagccacacaagttaaactctagattaaattcctcccgcggttagcctgacccgtgcccgggactcagtggagtcagccacgcaagttaaactctagattaaattcctcccgcggttagcctgacccgtgcccgggactcagtggggacagccacacaagttagactctagattaaattcctcccgcggttagcctgacccgtgcccgggactcagtggggacagccacacaagttaaactctagattaaattcctcccgcggttagcctgacctgtgcccgggactcagtggggacagccacgcaagttaaactctagattaaattcctcccgcggttagcctgacccgtgcccgggactcagtggagtcagccacacaagttaaactctagattaaattcctcccgcggttagcctgacccgtgcccgggactcagtggggacagccacgcaagttaaactctagattaaattcctcccgcggttagcctgacccgtgcccgggactcagtggggacagccacacaagttaaactctagattaaattcctcccgcggttagcctgacccgtgcccgggactcagtggagtcagccacgcaagttagactctagattaaattcctcccgcggttagcctgacccgtgcccgggactcagtggagtcagccacacaagttagactctagattaaattcctcccgcggttagcctgacccgtgcccgggactcagtggggacagccacacaagttagactctagattaaattcctcccgcggttagcctgacccgtgcccgggactcagtggagtcagccacgcaagttagactctagattaaattcctcccgcggttagcctgacccgtgcccgggactcagtggggacagccacgcaagttagactctagattaaattcctcccgcggttagcctgacccgtgcccgggactcagtggagtcagccacgcaagttagactctagattaaattcctcccgcggttagcctgacccatgcccgggactcagtggggacagccacgcaagttagactctagattaaattcctcccgcggttagcctgacccgtgcccgggactcagtggggacagccacacaagttagactctagattaaattcctcccgcggttagcctgacccgtgcccgggactcagtggagtcagccacgcaagttagactctagattaaattcctcccgcggttagcctgacccgtgcccgggactcagtggagtcagccacacaagttagactctagattaaattcctcccgcggttagcctgacccgtgcccgggactcagtggagtcagccacacaagttaaactctagattaaattcctcccgcggttagcctgacctgtgcccgggactcagtggagtcagccacacaagttaaactctagattaaattcctcccgcggttagcctgacccgtgcccgggactcagtggagtcagccacgcaagttagactctagattaaattcctcccgcggttagcctgacccgtgcccgggactcagtggagtcagccacgcaagttaaactctagattaaattcctcccgcggttagcctgacccgtgcccgggactcagtggggacagccacacaagttaaactctagattaaattcctcccgcggttagcctgacccgtgcccgggactcagtggggacagccacgcaagttagactctagattaaattcctcccgcggttagcctgacccgtgcccgggactcagtggagtcagccacacaagttaaactctagattaaattcctcccgcggttagcctgacccgtgcccgggactcagtggggacagccacgcaagttagactctagattaaattcctcccgcggttagcctgacccgtgcccgggactcagtggagtcagccaccccagacctctctcactgttatcatttttgcacaggtggtttcagcagcttgatgccaaaaaaaaaaaaaaaaaaggaaaagcattctgaaaagccatgtatgagtgaatcatacttaacttggcctcctttggctgcacagccatgccctgaatcgcccttgtggatccaagtgcatctgtgtggcttgaggcagagcttcccagccagacccagtgtgaaaggatgggacggccacacaggaacctgggccccaactgctccctccagacctgggtgggacttgcccgccatgcacaccctgctggggaagagggagtttctgagagtgacaggaagtggcccagccggagattcagccctgggatctctgtggccagcaactgtgggcgggggggtatgtggacatctgcttccattttccccaaacctaagattctgttccctggtcttcccctggcatttcttcctcgggcccagagccctctccttggggctccctattaccctgaggggagggccagcccaccagcccaggaccccatcctcatagccacaggccaggccagctctgctcagggctggctctcagctgcactctccatctaccctgccttgtcctccatgtctccaggcacctcccgccagccccaaggatacccacctcccagacctccctcttccctccacccaaaccccaggggagtgctacccctatggcccatgtggctccataaacccccttggtgctgtgcctgctcagggtccacaggccctccctcctcttcctcctcctcctcctcttcccccagctctgggctccatccgggtgcccctcccctgtgggctttaatccagccctctctccagggggacatggcgactgtgggtcttcctgactcaccagcagctgcacctccctccgcctccgccttcatacctctcccgcactccctgtgctgcctgtgccccaaagctctacccagagtgttcagtaaaatcaggggccaccggaggccccatcctgactgggggttggacctggggtgtgggctgtgcgcttgcctcgtccctcttagggcagggaggccacccctggccggtgccccactgccccaccaccccgtggcacccacccctccccacttcttcatattccatccccccttgcccattgctcctgcggctgggcagttccatcctgggggcccctccccagcacagtgctggcccagacagcaatccacgttgactaaagactctcaaaggggcttgcttgctttccattttagatggaagggaactgaagctgagtgcctgtaattcctgcccaggggtctcacagcaaccctggggtcctgcagccacataccaagagcagcctgtggccctggggtggccctgaaggggcaggttcctgtggggtcatcctctgagccggtttaaaattattctgacaggtgacggccacccacggactctgtcacttgctgggattcacacacggcacggaggcagagtggcagcaggtaaggagcccatccatcccactaccgagggggtgcgtgggggaaggaggctcccccaggcccctgccagcccccaccctccatcttgaccgcccccgcaggaactggacctcagacctgcccttgtaaaaatgacacagatgtttgctttcaacaccgggctccccaaatacttccagctgaatgtgttcactaaggaaagcggtctgagtgcagaggccgagagccacagctgacactagcacgtggcgcttggtcaaaaaggtccaatcagctagagactaggccagacccagggcggaggcgggagctctgcgtggagtgagttccgggttggtttcctccagacccatgcgctccgcctacggaggcccacgtgggctccggtccacatggttaacacgcacgcaagcccgtgttgggagcaaactgcttctctgaaagtcatgaaaaacctttttcattaaaaaaagaaaaagtttggccgggcgcagtggctcacgcctgtaatcccagcactttgggaggccgaggcaggcggatcaactgaggttgggagttcgcgaccagcctggccaacatggagaaaccctgtctctactaaaaatacaaaattagctgggcctggtggtgcatgcctgtaatcccagctactcaggaggctgaggcaggagaatcgcttgaacccaggaggcggaggttgtggttagccgagagatcgcgtcattgcactccagcctgggcaacaagagtgaaagtccgtctcaaaaagaaaaagaaaaagttggccaggcgcagtggctcacgcctgtaatcccagcactttgggaggccgaggagggtggatcacttgaggtcaggagttcaagaccagtctggccaacatggtgaaacccggtctctactaaaaacgcaaagattagccgggcgtggtggtgggcgcctgtaatcccagctacaggggaggctgaggcaggagaatcgcttgaacccgggaggtggaggttgcagtgagccctcctcccctcctcccccttcccttcccacctcccatgcccccctttcttcctcccactcccctcccgaggccccgcttattctcccggcctgtggcggttcgtgcactcgctgagctcaggttctggtgaaggtgcccggagccgggtcccgccttcggcctgagctagagccgcgcgggcggccggcttcccccaaaccctgtgggaggggcatcccgaggaggcgaccccagagagtggggcgcggacaccttccctggggagggccagcgcgcttccttccttccagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgtacgaggggaacctcctcttatttccttcacgttgcatcgggtatttttcgttattgtaaataaaacggttccgagccgtggcatcgagagggcgtctggagttcagggaacgcgtggcccccgcccgggagcaccgcgcagcgctcgcctctcgcccttcaagggggtccctgcccggagcctgcgcccccggagaggaaggggctcgaggggcttgggtgccgcagcgcgtccttccgtagaaaaggcttgcgtcagtatttcctgcttttacctcct

SEQ ID NO: 219 - DNA, 93 bp, Homo sapiens
  C21orf57 DMR
cgagccgtggcatcgagagggcgtctggagttcagggaacgcgtggcccccgcccgggagcaccgcgcagcgctcgcctctcgcccttcaagg

SEQ ID NO: 220 - DNA, 95 bp, Homo sapiens
  PCDHGA1 DMR
agcgactgccgctctaagtgccgggcgggcaggactctacgatccttgggccagaggtccggatggtcccgggactccgtctcaagggtcggcga

SEQ ID NO: 221 - DNA, 92 bp, Homo sapiens
  PCDHGA1 OR
gcgatctagggtcagagatttggaggtgaccaaactatctgacactctaacaagtcctgtctcctctggcagatggaaagctataggctctg

SEQ ID NO: 222 - DNA, 16 bp, Artificial Sequence
  Description of Artificial Sequence: Synthetic Primer Chr21DMR2-For
cgagccgtggcatcga

SEQ ID NO: 223 - DNA, 17 bp, Artificial Sequence
  Description of Artificial Sequence: Synthetic Primer Chr21DMR2-Rev
ccttgaagggcgagagg

SEQ ID NO: 224 - DNA, 21 bp, Artificial Sequence
  Description of Artificial Sequence: Synthetic Chr21DMR2-Probe
cgttccctgaactccagacgc

SEQ ID NO: 225 - DNA, 17 bp, Artificial Sequence
  Description of Artificial Sequence: Synthetic Primer Chr5DMR-For
agcgactgccgctctaa

SEQ ID NO: 226 - DNA, 17 bp, Artificial Sequence
  Description of Artificial Sequence: Synthetic Primer Chr5DMR-Rev
tcgccgacccttgagac

SEQ ID NO: 227 - DNA, 24 bp, Artificial Sequence
  Description of Artificial Sequence: Synthetic Chr5DMR-Probe
tctggcccaaggatcgtagagtcc

SEQ ID NO: 228 - DNA, 22 bp, Artificial Sequence
  Description of Artificial Sequence: Synthetic Primer Chr5OR-For
gcgatctagggtcagagatttg

SEQ ID NO: 229 - DNA, 23 bp, Artificial Sequence
  Description of Artificial Sequence: Synthetic Primer Chr5OR-Rev
cagagcctatagctttccatctg

SEQ ID NO: 230 - DNA, 28 bp, Artificial Sequence
  Description of Artificial Sequence: Synthetic Chr5OR-Probe
acactctaacaagtcctgtctcctctgg

SEQ ID NO: 231 - DNA, 105 bp, Homo sapiens
  C21orf29
acttgaatagccaaatgagtcctagaaagcgagagacgagaggggaatgagcgccgaaaatcaaagcaggttcccctcctgacaactccagagaaggcgcatggg

SEQ ID NO: 232 - DNA, 81 bp, Homo sapiens
  CGI149
cgtccggtgagcctaagacgcgcctttgccggggttgccgggtgtctgcctctcacttaggtattaggaaccgtggcacaa

SEQ ID NO: 233 - DNA, 23 bp, Artificial Sequence
  Description of Artificial Sequence: Synthetic Primer Chr21DMR3-For
acttgaatagccaaatgagtcct

SEQ ID NO: 234 - DNA, 17 bp, Artificial Sequence
  Description of Artificial Sequence: Synthetic Primer Chr21-DMR3-Rev
cccatgcgccttctctg

SEQ ID NO: 235 - DNA, 23 bp, Artificial Sequence
  Description of Artificial Sequence: Synthetic Probe Chr21DMR3
tcccctctcgtctctcgctttct

SEQ ID NO: 236 - DNA, 18 bp, Artificial Sequence
  Description of Artificial Sequence: Synthetic Primer Chr21DMR4-For
cgtccggtgagcctaaga

SEQ ID NO: 237 - DNA, 21 bp, Artificial Sequence
  Description of Artificial Sequence: Synthetic Primer Chr21DMR4-Rev
ttgtgccacggttcctaatac

SEQ ID NO: 238 - DNA, 22 bp, Artificial Sequence
  Description of Artificial Sequence: Synthetic Probe Chr21DMR4
ccgggtgtctgcctctcactta

SEQ ID NO: 239 - DNA, 106 bp, Homo sapiens
cctgggctgtgtctggtcccggccacgcgtccctgcagcgtctgagaccttgtggaacacacttgacccggcgctgggacggggtcggcccacacgcaccgccagc

SEQ ID NO: 240 - DNA, 111 bp, Homo sapiens
gccccagagcctcctttcggggcgcgaggcccggcgcgtgtgtacggagtccagtccccccagggagtggggtgcccgcaccttcttcctccgcgctcggagccacagggg

SEQ ID NO: 241 - DNA, 19 bp, Artificial Sequence
  Description of Artificial Sequence: Synthetic Primer Chr18DMR1-For
cctgggctgtgtctggtcc

SEQ ID NO: 242 - DNA, 16 bp, Artificial Sequence
  Description of Artificial Sequence: Synthetic Primer Chr18DMR1-Rev
gctggcggtgcgtgtg

SEQ ID NO: 243 - DNA, 23 bp, Artificial Sequence
  Description of Artificial Sequence: Synthetic Probe Chr18DMR1
tggaacacacttgacccggcgct

SEQ ID NO: 244 - DNA, 19 bp, Artificial Sequence
  Description of Artificial Sequence: Synthetic Primer Chr18DMR2-For
gccccagagcctcctttcg

SEQ ID NO: 245 - DNA, 17 bp, Artificial Sequence
  Description of Artificial Sequence: Synthetic Primer Chr18DMR2-Rev
cccctgtggctccgagc

SEQ ID NO: 246 - DNA, 20 bp, Artificial Sequence
  Description of Artificial Sequence: Synthetic Probe Chr18DMR2
tgcgggcaccccactccctg

The invention claimed is:

1. A method for detecting a chromosomal aneuploidy in a fetus carried by a pregnant female, said method comprising the steps:
  (a) providing a sample taken from said pregnant female, which sample comprises DNA that originates from cells of a fetus and/or the placenta of a fetus in admixture with differently methylated DNA of maternal origin;
  (b) treating the DNA present in said sample with a reagent that differentially modifies methylated and non-methylated DNA;
  (c) determining an amount of a first target species of DNA, being the chromosome relevant to the chromosomal aneuploidy, in said sample by detecting in said sample the presence of methylation at two or more first target differentially methylated regions (DMRs) located on said chromosome, said first target DMRs differently methylated between DNA that originates from cells of a fetus and/or the placenta of a fetus and DNA of maternal origin, the modification of DNA of the first target DMRs by said reagent is sensitive to methylation of DNA, wherein a detected amount of methylated DNA at one or more of said first target DMRs indicates said amount of first target species of DNA in said sample;
  (d) determining an amount of reference species of DNA, being one or more reference chromosomes, in said sample by detecting in said sample the presence of methylation at two or more reference DMRs located on said reference chromosome(s), said reference DMRs differently methylated between DNA that originates from cells of a fetus and/or the placenta of a fetus and DNA of maternal origin, the modification of DNA of such reference DMRs by said reagent is sensitive to methylation of DNA, wherein a detected amount of methylated DNA at one or more of said reference DMRs indicates said amount of reference species of DNA in said sample; and
  (e) determining relative amount(s) of an amount determined from step (c) and an amount determined from step (d), wherein one or more of said relative amount(s) indicates the presence or absence of the chromosomal aneuploidy in the fetus,
  wherein, said detections in step (c) and step (d) are made using the same aliquot of DNA of said sample, and in the same vessel, and effectively simultaneously for said first target DMRs and said reference DMRs, and using: (x) the same detectable label for at least two of said two or more reference DMRs; and (y) different detectable labels for at least two of said two or more first target DMRs,
  optionally, wherein in step (e) said relative amount(s) are compared with threshold(s) and/or reference distribution(s), wherein one or more of said relative amount(s) higher or lower than said threshold(s) and/or reference distribution(s) indicates the presence of the chromosomal aneuploidy in the fetus,
  wherein a sensitivity and specificity of the method is 95% or greater,
  optionally wherein the relative amount(s) determined in step (e) is a ratio(s); and
  optionally further comprising (f) determining an amount of total DNA in said sample by detecting at least one other region (OR) that is not differently methylated between DNA that originates from cells of a fetus and/or the placenta of a fetus and DNA of maternal origin, the modification of which OR(s) by said reagent is insensitive to methylation of DNA.

2. The method of claim 1, wherein two or more of said reference DMRs are located on different reference chromosomes.

3. The method of claim 1 further comprising the step:
  (f) determining an amount of total DNA in said sample by detecting at least one other region (OR) that is not differently methylated between DNA that originates from cells of a fetus and/or the placenta of a fetus and DNA of maternal origin, the modification of which OR(s) by said reagent is insensitive to methylation of DNA,
  wherein, said detection in step (f) is made using the same aliquot of DNA of said sample, and in the same vessel as the detections in step (c) and step (d), and effectively simultaneously for said first target DMRs and said reference DMRs and said other region(s), and wherein said detection in step (f) is made using detectable label(s) for the OR(s), which is/are different from the detectable labels used for the at least two first target DMRs of (y) and
  optionally (A) wherein said OR(s) is(are) located on one or more reference chromosome(s) and/or (B) wherein said OR is located between about 20 bp and 20 kb upstream or downstream of, and/or within the same gene as, at least one of said reference DMRs.

4. The method of claim 3, wherein said detection in step (f) comprises using at least two of said ORs;
  i) optionally wherein said detection in step (f) comprises detecting more than one OR, wherein said ORs are detected using: the same detectable label for each of said ORs,
  ii) optionally, wherein the number of said at least two ORs is the same as the number of reference DMRs used in step (d);
  iii) optionally, wherein one of said ORs is located on the same chromosome as a reference DMR used in step (d)

and each other of the said ORs is located on the same chromosome as another of said reference DMRs;

iv) optionally, wherein one of said ORs in step iii) is located between about 20 bp and about 20 kb upstream or downstream of the reference DMR used in step (d) and wherein each other of the said ORs in step iii) is located between about 20 bp and about 20 kb upstream or downstream of the another of said reference DMRs.

5. A method for detecting an increased risk of a pregnant female suffering from or developing a pregnancy-associated medical condition; said method comprising the steps:
(i) conducting the method of claim 3;
(ii) determining at least one amount of fetal DNA present in the sample; and
(iii) comparing the amount of fetal DNA determined with a threshold and/or reference distribution,
wherein an increase in, or outlying of, the amount of said fetal DNA from said threshold and/or reference distribution indicates an increased risk of the pregnant female suffering from or developing said pregnancy-associated medical condition,
optionally wherein the at least one amount is an absolute amount or a relative amount.

6. The method of claim 1, wherein said detection step (c) and step (d), and optional step (f), are made using the same aliquot of DNA of said sample, and in the same reaction/detection vessel, and effectively simultaneously with each other, and by multiplex real-time quantitative probe-based PCR using at least one labelled probe specific for each of the said DMRs and optional OR(s).

7. The method of claim 1, wherein said DNA that originates from cells of a fetus and/or the placenta of a fetus is circulating cell-free DNA and said sample is a blood fraction, herein optionally the blood fraction is plasma or serum.

8. The method of claim 1, wherein (A) said reagent that differentially modifies methylated and non-methylated DNA comprises bisulphite, or (B) said reagent that differentially modifies methylated and non-methylated DNA comprises an agent that selectively digests unmethylated over methylated DNA.

9. The method of claim 8, wherein the agent that selectively digests unmethylated over methylated DNA comprises:
at least one methylation sensitive enzyme;
at least one methylation sensitive restriction enzyme; and/or
an agent selected from the group consisting of: AatII, AciI, AclI, AfeI, AgeI, AgeI-HF, AscI, AsiSI, AvaI, BceAI, BmgBI, BsaAI, BsaHI, BsiEI, BsiWI, BsmBI, BspDI, BsrFI, BssHII, BstBI, BstUI, ClaI, EagI, FauI, FseI, FspI, HaeII, HgaI, HhaI, HinP1I, HpaII, Hpy99I, HpyCH4IV, KasI, MluI, NaeI, NarI, NgoMIV, NotI, NotI-HF, NruI, Nt.BsmAI, Nt.CviPII, PaeR7I, PluTI, PmlI, PvuI, PvuI-HF, RsrII, SacII, SalI, SalI-HF, SfoI, SgrAI, SmaI, SnaBI, TspMI and ZraI.

10. The method of claim 1, wherein one reference DMR is located on human chromosome 5 and another reference DMR is located on human chromosome 12.

11. The method of claim 10, wherein each of said first target DMRs is located on human chromosome 21, on human chromosome 18 or on human chromosome 13.

12. The method of claim 11, wherein each of said first target DMRs is located on human chromosome 21.

13. The method of claim 1, wherein said target and reference DMRs are hypermethylated in fetal DNA and hypomethylated in maternal DNA.

14. The method of claim 1, wherein
(A) said first target DMRs are located at C21orf57 located at position 46,286,337-46,297,751 on GRCh38:CM000683.2 or a DNA sequence of no more than 10 kbp, 5 kbp, 1 kbp, 500 bp, 250 bp, 150 bp, 100 bp or 50 bp upstream and/or downstream from such region and/or gene; or wherein said first target DMRs are each located in a region and/or gene selected from the group consisting of
SEQ ID NOs: 47-53, 148-186 and 187, and/or
(B) wherein said first target DMRs, and/or optional second target DMRs, are each located in a region and/or gene independently selected from:
VAPA-APCDDI located at position 9,914,002-9,960,021 on GRCh38:CM000680.2 or a DNA sequence of no more than 10 kbp, 5 kbp, 1 kbp, 500 bp, 250 bp, 150 bp, 100 bp or 50 bp upstream and/or downstream from such region and/or gene; or
maspin located at position 63,476,761-63,505,085 on GRCh38:CM000680.2 or a DNA sequence of no more than 10 kbp, 5 kbp, 1 kbp, 500 bp, 250 bp, 150 bp, 100 bp or 50 bp upstream and/or downstream from such region and/or gene; or
wherein said first target DMRs, and/or said optional second target DMRs are each located in a region and/or gene selected from the group consisting of: SEQ ID NOs: 35-45 and 46; and/or
(C) wherein said first target DMRs, and/or said optional second target DMRs, are each located in a region and/or gene independently selected from the group consisting of:
SEQ ID NOs: 15-33 and 34.

15. The method of claim 1, wherein said reference DMRs are each located in a region and/or gene independently selected from the group consisting of:
RASSF1A located at position 50,329,782-50,340,980 on GRCh38:CM000665.2, TBX3 located at position 114,670,254-114,684,164 on GRCh38:CM000674.2, ZFY located at position 2,935,281-2,982,506 on GRCh38:CM000686.2, CDC42EP1 located at position 37,560,447-37,569,405 on GRCh38:CM000684.2, PCDHGA1 located at position 141,330,571-141,512,981 on GRCh38:CM000667.2, SOX14 located at position 137,764,284-137,766,338 on GRCh38:CM000665.2, and SPN located at position 29,662,979-29,670,876 on GRCh38:CM000678.2 or a DNA sequence of no more than 10 kbp, 5 kbp, 1 kbp, 500 bp, 250 bp, 150 bp, 100 bp or 50 bp upstream and/or downstream from such region and/or gene; or
wherein said reference DMRs are each located in a region and/or gene independently selected from the group consisting of: SEQ ID NOs: 35-146 and 147.

16. The method of claim 1, wherein a plurality of sets of determinations are made for step (c) and step (d), and optional step (f), with each set of said determinations made using a different aliquot of DNA of said sample, in a different vessel and effectively simultaneously with each other member of the plurality of sets of determinations, and
optionally wherein the relative amount(s) or optional ratio(s) determined in step (e), is determined from said plurality of sets of determinations made for step (c) and step (d), and optional step (f),
optionally wherein the relative amount(s) or optional ratio(s) determined from said plurality of sets of determinations made for step (c) and step (d), and optional step (f) are determined by using an average amount of DNA determined for each set, and optionally wherein the average amount of DNA determined for each set is a mean, median or mode amount of DNA or optionally wherein the average amount of DNA determined for each set is a mean.

17. The method of claim 1, wherein (A) an amount of the first target species of DNA is determined from the detected amount of methylation at one of the first target DMRs and an amount of the first target species of DNA is determined from the detected amount of methylation at another of the first target DMRs; and (B) wherein two or more relative amount(s) are determined in step (e) for two or more amounts of first target species of DNA, each in respect of one or more of said first target DMRs; and (C) wherein two or more of said relative amount(s) indicate the presence or absence of the chromosomal aneuploidy in the fetus.

18. The method of claim 17, wherein in step (e) two or more of said relative amount(s) are compared with threshold(s) and/or reference distribution(s), wherein two or more of said relative amount(s) higher or lower than said threshold(s) and/or reference distribution(s) indicates the presence of the chromosomal aneuploidy in the fetus.

19. The method of claim 17, wherein said relative amount(s) is a ratio(s).

20. The method of claim 1, wherein at least one of said first target DMRs is located in a portion of the genome and/or a gene that is DSCAM located at position 40,010,999-40,847,139 on GRCh38:CM000683.2 and/or C21orf57 located at position 46,286,337-46,297,751 on GRCh38:CM000683.2 or a DNA sequence of no more than 10 kbp, 5 kbp, 1 kbp, 500 bp, 250 bp, 150 bp, 100 bp or 50 bp upstream and/or downstream from such region and/or gene.

21. The method of claim 1, wherein (A) one of said first target DMRs is located in DSCAM located at position 40,010,999-40,847,139 on GRCh38:CM000683.2 and another of said first target DMRs is located in C21orf57 located at position 46,286,337-46,297,751 on GRCh38:CM000683.2 or a DNA sequence of no more than 10 kbp, 5 kbp, 1 kbp, 500 bp, 250 bp, 150 bp, 100 bp or 50 bp upstream and/or downstream from such region and/or gene; and (B) one of said reference DMRs is located in TBX3 located at position 114,670,254-114,684,164 on GRCh38:CM000674.2 and another of said reference DMRs is located in PCDHGA1 located at position 141,330,571-141,512,981 on GRCh38:CM000667.2, or a DNA sequence of no more than 10 kbp, 5 kbp, 1 kbp, 500 bp, 250 bp, 150 bp, 100 bp or 50 bp upstream and/or downstream from such region and/or gene.

22. The method of claim 21, wherein (i) one of said first target DMRs comprises SEQ ID NO.: 201 and another of said first target DMRs comprises SEQ ID NO.: 219; and (ii) one of said reference DMRs comprises SEQ ID NO.: 203 and another of said reference DMRs comprises SEQ ID NO.: 220.

23. The method of claim 1, wherein in step (e), said relative amount(s) are compared with threshold(s) and/or reference distribution(s), wherein one or more of said relative amount(s) higher or lower than said threshold(s) and/or reference distribution(s) indicates the presence of the chromosomal aneuploidy in the fetus.

24. The method of claim 23, wherein the threshold and/or reference distribution is/are determined from a plurality of samples, each sample taken from a different pregnant female, wherein said method is conducted on the plurality of samples each taken from the different pregnant female, each method being conducted in a separate vessel, and effectively simultaneously with each other member of the plurality of samples.

25. The method of claim 1, further comprising:

subjecting the pregnant female to an invasive method for detecting the chromosomal aneuploidy in the fetus carried by the pregnant female, wherein prior to subjecting the pregnant female to the invasive method, the presence of the chromosomal aneuploidy in the fetus is indicated.

26. The method of claim 25, wherein the invasive method comprises chorionic villus sampling or amniocentesis.

27. The method of claim 1, wherein at least one other first target DMR(s) has/have the same detectable label as one of the at least two differently labeled first target DMRs of (y).

28. The method of claim 27, wherein no more than two detectable labels are used to detect the at least two differently labeled first target DMRs of (y) and other first target DMR(s).

* * * * *